United States Patent 9,115,368 (GENES AND USES FOR PLANT IMPROVEMENT) - sequence listing, part 3

SEQ ID NO: 8947 - protein, 458 aa, Escherichia coli CFT073
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 8948 - protein, 484 aa, Rhizobium sp. NGR234
MKLKDKELFRQAGVIGGEWIGAASGDVVEVFDPASQAVLGTVPDMGTAETRAAIEAAETAFGPWKKKTHAERAALLERWHALMIEHLEDLALILTLEQGKPLDEARGEIRYGAAFVKWFAEEARRIGGHTIPSPTPDRRIVVLKEAVGVCAIVTPWNFPNAMITRKVAPALAAGCTVVIKPSEFTPFSALALGVLAERAGIPAGVVNIVTGMPTAIGNEIMANETVRKISFTGSTRVGSLLMRGAADSVKRLSLELGGNAPFIVFDDADLDLAVEGAIASKFRNGGQTCVCANRILVQSGVYDAFAEKLAARVNAMKVGPGTEPGVAIGPMINAAAIDKIDRHVEDALAKGAKIAARGRSLPVGRQYTAPLVLTGATTEMLLASEETFGPVAPLFCFETEEEAITIANGTPFGLAAYFYTENLKRSWRVAEALEFGMVGLNTGAISTEVAPFGGVKQSGLGREGAQVGIEEYLELKSFHIGGLA

SEQ ID NO: 8949 - protein, 341 aa, Staphylococcus epidermidis ATCC 12228
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVAVKIGQLIDDKAMVKAI

SEQ ID NO: 8950 - protein, 288 aa, Magnetospirillum magnetotacticum
MSEELWQKYYGQPNKMYGNKVQFGMLLDINKCLACHSCTMACKTTWTSGPGQENMYFNSVSTQPYGKYPRRNGANDPAYFDYRFSNLYQDTPKGTYPKLWQFYLARPCNHCTDPACLKACPTRSIYKNEDGIVLIDQDKCEGFQYCVRACPYDKIYYNSVTKKSQKCIFCFPLLEKGQEPQCVKSCVGKIRIFGNLMDPESTISKMIRDPSLGVKPYDPQTSLKATHRVINEGERRQYRPDFGTIPSVWYVPPKNIPPEEVEKYFGFGMKGLLDEPHQVSGPTKMKDI

SEQ ID NO: 8951 - protein, 234 aa, Triticum aestivum
  unsure (1)..(234): unsure at all Xaa locations
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICAWCGFIILGIVINCGXGVGDQGYIGVKYWQDPGAFTSFKGFCAVFVVA

SEQ ID NO: 8952 - protein, 488 aa, Chordaria chordaeformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNIPAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMGLARNGGRDYVGEGPEILRRAATTCGPLKAALDLWEDITFDYTSTDTPDFVEVATESR

SEQ ID NO: 8953 - protein, 259 aa, Triticum aestivum
FPLYERLLEGQVNLQRGAAPVDQLPRIDAQIAARAPPPMPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGDGNAEQSW

SEQ ID NO: 8954 - protein, 99 aa, Zea mays; identical to SEQ ID NO: 3237

SEQ ID NO: 8955 - protein, 336 aa, Streptococcus dysgalactiae
MVVKVGINGFGRIGRLAFRRIQNVEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 8956 - protein, 426 aa, GIBBERELLA ZEAE PH-1
MSNQTQKLQPAGRVQGQKKDVWSMINEAAASSPIQPIVNLGQGFFGYNPPDFILNAAKEALDRVECNQYAPAKGRPRLRQALADAYSPSWGRQLDPETEIIITTGANEGMLSAFMGFIEAGDEVIVFEPFFDQYISNIQMPGGKVVYVPLHPPKTGATKNSSAADWTIDFEELEKAFTPRTKMIVINTPHNPVGKVFSKEELQGIADLAVKHQVIILSDEVYDKLYYVPFTRIANLSPEVEKLTLTVGSAGKNFYATGWRVGWLIGPQELIQYVTAAHTRICFSTPAPFQEASAIGFEQAGKNGFWDETIKEMKGKIDRLKEVFEELELPVTYPEGGYFLLVNMAKVKLPEDYPFPPHVASRPRDFKLAWFLIQEIGVAAIPPTEFYTPVNAHLAEDYIRFAVCKNDDILEQAKERLRGLKKYIPE

SEQ ID NO: 8957 - protein, 203 aa, Cucumis sativus
VLTGDSGVGKSNLLSRFSKNEFRFDSRPTIGVEFAYRNIKVADKLVKTQIWDTAGQERFRAITSSYYRGALGALLVYDITRVATFDNIKKWLRELREFGNPEMVIILVGNKCDLHQSREVQEEEARHLAELENLFFMETSAKDNLNVEEAFLEMVRRIHAIASQKTLDLHKKFEKLVAFPNGKEIISIHEVTPTKPNSNCCSL

SEQ ID NO: 8958 - protein, 356 aa, Ferroplasma acidarmanus
MVDIAVIPGDGIGKEIIPQVCDLVTSIDPSVNFTFYNISSERYINKGITIKDSEIDELKSYNSIFFGAIGDFRVKPGIMEQGVILRLRKELDLYMNIRPAISFSRITGNNIHMTILRENKEDFYSDISGSLNEHKLFRQKGNFYNYNIDINSESDDTIYYTMGFLSRKNLKRFFNMAYKIADTETVTITDKANAVDMYSLWREIAIEESEPAGKKINFEYADSLAYNMINNPLKYRYIIAPNLYGDILSDMSSAMVGGLGYAPSGNIGDYSSMFEPVHGSAPDIAGKNIANPVASILSCIMMLKHLNQTETAGIMEKSVENVIRNGTIPIESGGNAGTHEFINKVKNYCTMTKNNI

SEQ ID NO: 8959 - protein, 446 aa, Zea mays
MGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDRSKVDDLRGTPMNVGSLEEIIDESHAIVSSSVGPEYYVGILSFVDKDQLEPGCAILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDVKTRRRIFQIHTSKMTLADDVNLEEFIMSKDEFSGADIKAICTEAGLLALRERRMKVTHADFKKAKEKVMFKKKEGVPEGLYM

SEQ ID NO: 8960 - protein, 326 aa, Candida albicans
MTGSSSQFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQHPHQPIIDQQY

SEQ ID NO: 8961 - protein, 508 aa, Ferroplasma acidarmanus
MNTGLKGMNRIEMRYLAKLLPVFLRFSSDRKKSKKQEEYDYKIENHGRAAVNAFIELGPTFIKLGQVLSARPDLLPKEYLKAFSDLQDKVPPDNFVYAKQIIEENVGKMETVFESFDENAISGASLGQVYRAKYKGRDAAVKVNRHNIDNVLKRDLIIIKKLLNMFKRFIDNYLYISISNVLSDFSARIYDETNYLVEAENIKRIGNNIKKYDIIIPEVLFASRQVIILTYIGGIKVTDTKKLKEKGIDLPKLAHNLDLTFIRMLLRNDIFHADPHPGNIAISDEGKIILYDFGMVGKLDDDTRFKLLKLYDGLINKDPDTIMDSLLQLNALSPAANRGIIRKGIELSIANLSGANVNEMDIRELLEIANNVIFEFPFHLPRELVLYMRMSSLLEGICKTLDPNFKFVLVLRDILYNEGMLQELYLKEMNEFAQKSIISIEKGLDVLPLLKRALEERNGETNENKKLPSTVFLSAILIAMVLFSRIHPVISYIVIIIDIILFAYIIKK

SEQ ID NO: 8962 - protein, 449 aa, Zea mays
MHHQQRMKQAAAAAAAAQQQQLMQQALLLQQQQQSQAQPPLFPGHHPHPGLLAAPQIEPIVSGNLPPGFDSSTCRSVYVGNIHLQVTDTVLQEVFQSIGPVEGCKLIRKEKSSFGFIDYYDRRYAALAILSLNGRQLYGQPIKVNWAYTSTPREDTSGHFNIFVGDLCPEVTDATLFAFFSGYSTCSDARVMWDQKTGRSRGFGFVSFRNQQDAQSAINDLNGKWLGNRQIRCNWATKGANAGEEKQILDTKVDLSNGSSESGKENPNDDGPENNPQFTTVYVGNLPHEATMNDVHLFFHSLGAGSIEEVRVTRDKGFGFVRYSTHEEAALAIQMGNGQLIGGRQIKCSWGSKPTPQGTASLPLPPPALAPFSTGVSATDLLAYQRLTLSKMASNPALMGQHALKQVAALGIGGGASQSIYDGGFQGINTATGTTSVQQQQQQQQLMYY

SEQ ID NO: 8963 - protein, 517 aa, Agaricus bisporus
GLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 8964 - protein, 85 aa, Glycine max
IIKFSCDFHFNIVAVAYNREGKIFVWELQSSPPVLAAKLSHPQSKSPIRQTATSFDGSTILSCCEDGTIWRWDVSKPSTSTSTAA

SEQ ID NO: 8965 - protein, 575 aa, Zea mays; identical to SEQ ID NO: 5671

SEQ ID NO: 8966 - protein, 409 aa, Aster tripolium
YFGSLTQASTIRVGSFNGEEIYAPFKSLLPMVNPDDIVFGGWDISSMNLADAMARARVLDIDLQKQLRPYMESMVPLPGIFDPDFIAANQGSRADNVIKGTKNEQVQKIIKDIREFKEANKVDKVVVLWTANTERYSNVVVGLNDMENMFASLDRNEAEISPSTLYAIACILENVPFINGSPQNTFVPGVIELAIKRNPLIGGDDFKSGQTKMKSVLVDFLVGAGIKPTSIVSYNYLGNNDGMNLSAPQTFRSKEISKSNVVDDMVSSNAILYEPGEHPDHVVVIKYVPYVADSKRAMDEYTSEIFMGGTNTIVMHNTCEDSLLAAPIILDLVLLAELSTRIQLKSETEGKFHSFHPVATILSYLTKALFVPPGTPVVNALAKQRAMLENIMRACVGLAPENNMILEYK

SEQ ID NO: 8967 - protein, 154 aa, Zea mays
RENCFTYGTWFAIDGLSAVGQSYGNSTCIQKACKFLLAKQLKNGGWGESHLSSTTKAYTNLDKEKSHIVNTAWAMLALMKAGQAERDPTPLHKAARLIMSMQLSNGDFPQEEMIGSFLKNGPLCYMAYRNIFPIWALGEYQKLVLQCDLQWPTF

SEQ ID NO: 8968 - protein, 294 aa, Petroselinum crispum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRITGTPNEDTWPGVTSLPDFKSAFPKWPSKELETVVPNLDSAGLNLLKKMLCLDPSRRITARIALEHEYFKDIGIVP

SEQ ID NO: 8969 - protein, 295 aa, Streptomyces antibioticus
MRGIILAGGNGTRLAPMTSVVSKQLLPVYGKPMIYYPLSVLLSVGITDILVIARPQDLPLFERLLGDGSRFGACFDYAEQETPRGLADALIVGREHVGDDDVALILGDNIFHGHDFGSIVADAIKNNVGATLFAYEVSDPERYGVVRVDRFGTLLDVVEKPSNPPSNLAITGFYLFDNDALDVAAGLSPSPRGELEITDVIKHFVDRGLARAVPLTDGFVWLDAGTPDSYVDACNYVQAIETRQGRMIACPEEVAFVKGLTGEDQLLAAAAEFGSSEYGRYLTRLAGRFIERSAA

SEQ ID NO: 8970 - protein, 61 aa, Prochlorococcus marinus subsp. pastoris str. CCMP1378
MEFSNKPILPGSIVVVKDVNSIYRGYKGFVQRVTNKTAAVLFEGGNWDKLVTFQLNNLELV

SEQ ID NO: 8971 - protein, 336 aa, Lycopersicon esculentum
MSHHYQEQEQLEAQKIPFLLDSLYCEENNILTEVSIETESFSSHDLLWEEEELTSLFSKETEYEISYNVLEKNQSFISSRRESVEWILKTTAYYSFSAQTGFLAVNYFDRFLLFSFNQSLNHKPWMNQLVAVTCLSLAAKVEETDVPLLLDLQVEESGFLFESKTIQRMEMLILSTLKWKMNPVTPFSFLDFITRRLGLKHCLSLEFLRRCEKVLLYTITDDRFIGYLPSAMASATMLHVLDRLKPCIGEKYQDQLLGILGIVKEKVEGCYRLIQEVACNIDFGSNKRKFGTLPGSPTGVMDMSFSSDYSNDSWSVATSVTSSPEPLSKKIRESNE

SEQ ID NO: 8972 - protein, 299 aa, Photobacterium profundum
MPEFHRSEMPEFTIHEYEPLIDSSDMSPEDWQRIADDIKANYDKYDGFVILHGTDTMAYTASALSFMFENLDKPVIVTGSQIPLAELRSDGQSNLLNSLHIAANYPINEVTLFFNNQLIRGNRSTKAHADGFGAFISPNMPPLLEAGINIKLNNIELDKKPEGDFKVNAITPQPIGVITMYPGISPEVIRNTLRQPVNAMILLTFGVGNAPQNPDLLAQLKEASERGVIVMNLTQCLSGKVNMGGYATGCALADAGVLSGYDMTLEAALAKLHYLLSTDFPVETIRSMMQQDLRGELSL

SEQ ID NO: 8973 - protein, 401 aa, Listeria monocytogenes EGD-e
MESVFMFFCTLLVWLMTPGIALFYGGMVRRKNVLSTAMYSFSSMAIISILWVIVGYSLAFAPGNGFIGSFDWTFLHNVGFAANATYSDAIPHVLFMMFQMTFAILTVAIISGAFAERMNFSAYLIFIILWSLLVYSPVAHWVWGDGGWLRNLGALDFAGGNVVHISSGVTGLVLAIMIGRRKEADSASPHNLPLALIGGILVWFGWYGFNVGSALTIDNVAMTAFVNTNTAAAAGIIGWGLVEWLTNKKPTMLGTISGAIAGLVSITPAAGFVTVPSSLIIGFFGGALCFWAVFWLKGKVKYDDALDAFGLHGIGGIWGGIATGLFATTKVNEAGADGLFYGNASLVVKQLIAIGSTVAYVAVVTALIVVIIKLFLPIRVNEEQEYKGLDLTLHGEKAYQE

SEQ ID NO: 8974 - protein, 276 aa, Triticum aestivum
  unsure (1)..(276): unsure at all Xaa locations
KQHSSLGSASISDSRRSDPTRPPPRLGRRTVTAPSKKGAAVGRSPCCEKAHTNKGAGTREEDGRLVAHVRAHGEXGCRRSLPGAAGLLRCGKRCRLRWINYLRPDLNRDNFNGDEDELIVNLHSLLGNKWSLIAARLAGRTDNEMKNYAWHTHIRRKLLGRGIDPVTHRPLTDAATVSFVHPAEAPKQQATEERKPPRCPDLNLDLCISLPFQQEEERPPARACAKPVKMEQLQQGGICFRCSILRVRGAATECSCGSNFLGLRAGMLDFRGLEMK

SEQ ID NO: 8975 - protein, 371 aa, Agrobacterium tumefaciens str. C58 (Cereon)
MDGTPISPTARAKASSSDCNRGILLKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 8976 - protein, 354 aa, Eucalyptus gunnii
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYRPLVRFGLKQSGLRGGILGLGGVGHMGVKIAKAMGHHVTVISSSDKKRTEALEHLGADAYLVSSDENGMKEATDSLDYVFDTIPVVHPLEPYLALLKLDGKLILTGVINAPLQFISPMVMLESITGSFIGSMKETEEMLEFCKEKGLTSQIEVIKMDYVNTALERLEKNDVRYRFVVDVVGSKLD

SEQ ID NO: 8977 - protein, 384 aa, Shigella flexneri 2a str. 301
MAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKCYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENHDRIRQAIRGIKAMFRADGLLPVSSKHIHENAE

SEQ ID NO: 8978 - protein, 330 aa, Mesorhizobium loti
MPDYDVLCIGNAIVDIIAQCDEEFLETNGIIKGAMNLIDTHRAELLYSRMGPAIEASGGSAGNTAAGVASFGGRAAFFGKVSNDALGEIYAHDIHAQGVAFDTRPLAGLPPTARSMIFVTPDGERSMNTYLGAATELGPEDVEADKASGAAVTYFEGYLWDPPRAKEAIRQTAKLAHAAGREVSMTLSDSFCVDRYRDEFLKLMRSGTVDIVFANSHEIKSLYQTASFDEALAQIRKDCKIAAVTRSEKGSVIVRGDETVVIQATAIKELVDTTGAGDLYAAGFLHGYTQGRDLKTCGDLGSLAAGLVIQQIGPRPRQNLRREAEQAGLL

SEQ ID NO: 8979 - protein, 195 aa, Mitthyridium sp. Wall 3637
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFVK

SEQ ID NO: 8980 - protein, 497 aa, Oryza sativa
MATCLDSLGPLLGGAANSTDAANYICNRFTDTSSAVDATYLLFSAYLVFAMQLGFAMLCAGSVRAKNSMNIMLTNVFDAAAGALFYYLFGFASRRTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALNHAVRQEMADGALERDRRLQRSPRRVRAITAGCSVVDPWASVICGFVSAWVLIGCNKLALMLKFDDPLEATQLHGGCGAWGIIFTALFARKEYVELIYGVPGRPYGLFMGGGGRLLAAHIVQILVIVGWVSATMGTLFYVLHRFGLLRVSTSTEMEGMDPSCHGGFGYVDEDEGQRRVRAKSAAETARVEPRKSPEQAAAGQLV

SEQ ID NO: 8981 - protein, 85 aa, Buchnera aphidicola
YEPAGGSAPDIAGKNIANPIALILSIAMLVRYTMKLPTISDHIEYAVIDTLKKGYRTADIANDKEKYVSTNDIGDIISDILKKRI

SEQ ID NO: 8982 - protein, 260 aa, Oryza sativa (japonica cultivar-group)
MAATLSSAPAPSKHCSIVRAQHSPPPSILSSSTKTAFHGLSLVDRRWAASVGGGSGRRRRVLQVNARTAGAAKNIEVEVDKPLGLTLGQKTGGGVVITAVDSGGNAARAGLKSGDQVLYTSSFFGDELWPADKLGFTKTAIQAKPDSVYFVVSRGAQVDVKRLPKRPAPPRFGRKLTESQKARATHICLDCGYIYFLPKPFEEQPDEYGCPQCNAPKKRFAKYDAETGRAIGGALPPITVIVSLIIGIAGVGALLVYGLQ

SEQ ID NO: 8983 - protein, 355 aa, GIBBERELLA ZEAE PH-1
MSTQQKFEGWVAEKSTKEQDLVWKEYEMKPFEDTDIEIRITHCGVCGTDDHISKNGWGSTKYPIIVGHEIVGVATRIGSKAEGDIKEGDIVGVGAQSDACFERDGPCEECANGLYNYCSKNTPTYGGVHWCGTPSTGGYARYHRCPSRFVVKIPQGLAPELAAPMLCAGATMYAPLNYFGATGRKVAIIGIGGLGHFGIMFAKALDAAEVVAISRGSDKKGDALTLGADEHIATSEEGWAEKNKRRFDLIINTADGSNMPWNEYLGLLRVDGTMVSVGAPEKPIPINIFSLLPIRGRFTSTSVATPNEVRDMLQLAADKSLKPWVEERPMREANEALKDLQAGKPRFRYVLVNED

SEQ ID NO: 8984 - protein, 534 aa, Chlorella kessleri
MAGGGVVVVSGRGLSTGDYRGGLTVYVVMVAFMAACGGLLLGYDNGVTGGVVSLEAFEKKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGPAAAPGAILFLGSLVLPESPNFLVEKGKTEKGREVLQKLCGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 8985 - protein, 495 aa, Glycine max
MELGAPVTRDTGFEPLLWLGHISCLVPPHRYVNHSNFPSLTFAYSKTKSMGQGTPGGLNRQGLPGDRKPDGGDKKEKKFEPAAPPARVGRKQRKQKGPEAAARLPTVTPLSKCKLRLLKLERIKDYLLMEEEFVANQERLKPQEEKAEEDRSKVDDLRGSPMSVGNLEELIDESHAIVSSSVGPEYYVGILSFVDKDQLEPGCAILMHNKVLSVVGLLQDEVDPMVSVMKVEKAPLESYADIGGLDAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 8986 - protein, 201 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYLGRDHA

SEQ ID NO: 8987 - protein, 204 aa, Citrus unshiu
KLGDDEFGHMLVNILKQNNVKTEGVCFDNHARTALAFVTLKKNGEREFMFYRNPSADMLLKDSELNMGLIKQAKIFHYGSISLISEPCRSAHMAALKAAKDAGVLLSYDPNVRLPLWPSQDAARDGIKSIWNHADLIKVSDDEVNFLTKGGDAEKDDVVMSLWHDNLKLLLVTYGAKGCGYFTKKFKGRVPGFSVKTVDTTGAG

SEQ ID NO: 8988 - protein, 360 aa, Listeria monocytogenes EGD-e
MKWKKSLAGLSSYKPGKREEEVMAELGLTKITKLSSNENPLGTSPKVAALQANSNVETEIYPDGWASSLRKEVTNFYQLEEEELIFTAGVDELIELLTRVLLDTTKNTVMATPTFVQYRQNALIEGAEVREIPLLTDGAHDLEGMLNAIDEKTTIVWICNPNNPTGNYIDLADIQAFLDKVPSDILVVLDEAYIEYVTPQPKKHEKLIRTYKNLIITRTFSKIYGLASARVGYGIADKEIINQLNIVRPPFNTTSIGQKLAIEAIKDQAFIEACRISNANGIKQYEAFAKRFEQVKLYPANGNFVLIDLGIEARTIFSYLEKNGYITRSGAALGFPTAVRITIGKEEENSAVIALLEKLL

SEQ ID NO: 8989 - protein, 481 aa, Opephyllum martensii
  unsure (1)..(481): unsure at all Xaa locations
GQAIKNERYESGVIPYAKMGYWDPNYVTKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMXXXXXXXXXXXXXXXXXXXXXXVIIMIDLVIGYTAIQTMAIWARKNDMILHLHRAGNSTYSRQKVHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 8990 - protein, 486 aa, Listeria monocytogenes EGD-e
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 8991 - protein, 471 aa, Zea mays
  unsure (1)..(471): unsure at all Xaa locations
PPPPFFPLPPRLHPFPSISSHLATPLPLSRADRLAHPSIEHGKKIPVRRGLNSIGLVLVWVGTMAATEASADKNAVFRKLRTKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLAKEVAKSATEDGNNSWPSSPVAASQASDQTAAFPDLKLTEVSKENVSEKEDSEIVRSPRVPTRSIKKPIGAKKPGNKTGGLGARKLTSKPNESLYEQKPEETAPVLPSSVIASTTARSKPHTSRFEYVENAPAPKTGSSSEGNLMSGHVAPPKSSNFFVEFGMDSGYHKKXSTSSSSKVQIEESSEARQKFSNAKSISSSQFFGDQASFEKDTQVSLQKFSGSSAISSADLFGHPANNSSVDLSASDLINRISFQATQDLSSLKNMAGETGKRLTSMASNIITDLQDRIL

SEQ ID NO: 8992 - protein, 858 aa, Oryza sativa
MPNLDTCTYRACLPAICRSSPDRDGNCNTRTISNAEIVGKIYHGIKNGGVTVIYVHETDTDYVRARTWTAYGWYSSGWYSSVPSPGNSTAPREGFLAKSSRTLRWQLVYAAPKDRAVINRARVKRQRKKFHGNFHHVNSSWSIKWSSSIRVKHRITARFRRQGVHPVRSAYVKIPIGTESTYVQIQIFKSRSSIHMISSPKIQVSITVQYQDSNQRQGTDMRARLTPGINTVVPYIQRQKGRRSNFNISNYISKFPNCCSYLLSPSFPKGAQKALKKVADLRHGQPPARGPPGKPSLTGRLASPGGDPALASGDRRRGERRRERERGGKMAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQASNFPIILSGEYVQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSVDRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 8993 - protein, 358 aa, Oryza sativa
MMFLLLVLTRVMSLMHNAGLLLNGNFEYQPSKSQMNGTRVMAEYAIPYWKITGFVEYISSGQKQGDMLLTVPEGAHAVRLGNEASIEQQISVTRGMYYSITFSAARTCAQSEKLNVSVAPGPESGELPIQTVYTSSGWDSYAWAFKAKRGLVSLIIHNHGEDDDPACGPLIDSVAIKTLYPPQATQNNMLRNGDFEEGPYMFPNAAWGVMVPPISEDDHSPLPGWMVMSDTKAVKCVDSAHFTVPHGARAVELVSGLETALMQEVRTVPGRSYRLEFSVGDASDGCVGSMQVKGYAGQGCTTVTYSSQGTGGHTRASLEFAAVANTTRVVFVSSTYITKWDGTLCGPVVDDASLVCVS

SEQ ID NO: 8994 - protein, 278 aa, Glycine max
  unsure (1)..(278): unsure at all Xaa locations
MMTPTGGEGAEKMDAEDGVNCSDYEHDIENEESGGYWSGIYDRNMAHTMPLLMKRANTTSQIAIVGANPCPIESLDYEIFDNEILKNDWRSKKKVQIIXYVMLKWGFALLIGLGTGLVGFFNSFAVENIAGFKLLMTTGLMSKHRYLDAFLAYAGANMCLAAAAAALCAFIAPAAAGSGIPEVKAYXNGVDAQNILAPSTLFVKIFWFHPXEFLLDFVVGKEGPMVHTGACIASLLGXGXGSHKYHLTCTWLRYFKNDRDRRDXXTCGAAALLPPFRA

SEQ ID NO: 8995 - protein, 370 aa, Oryza sativa
MAIMVDPPNGMGNQGKYYYSMWQTLFEIDTKYVPIKPIGRGAYGIVCSSINRETNEKVAIKKIHNVFDNRVDALRTLRELKLLRHLRHENVIALKDIMMPVHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKSLPYTPGVPLASMYPHAHPLAIDLLQKMLIFDPTKRISVTEALEHPYMSPLYDPSANPPAQVPIDLDIDENISADMIREMMWHEMLHYHPEVVAAMSAR

SEQ ID NO: 8996 - protein, 562 aa, Oryza sativa
MVAEAKQGEGKEAGQARPQQCGQGSVTARGEDGEYVQGQFGPITSKCGQMRVRRSAAEQARQRVGNKRERGRGGGGAVGGGQQASAVERRAWPVSVSSLAPHSPAFVVVGHRFLSPSFLVVVLSAPSYGEGGSCAGWASSDGLASRLPLPPKLFRPAATDRDDDEEDDDEDPVLVGIVRHIPCAFDSANRLLSSSPAAAVALSDLLLSHRSRRTGRLLSFSPPPSLRQPALSPFYHRPRTTAVTWTFSKPPGYTDDDQLKSRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKGYRSVMSASEGKLKGIIGYVEEDLVSTDFVGDSSNRVIDLIRHMAKTQ

SEQ ID NO: 8997 - protein, 304 aa, Zea mays
MAATSTFLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 8998 - protein, 521 aa, Cicer arietinum
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 8999 - protein, 492 aa, Pseudomonas putida KT2440
MAVFASDSFGQLKVEKIMTAQWNHYINGEYVSPESEEYIHEFIPTTALPGDSIARGSAADVDKAVRAAAAAQPAWNARKPIERGRILLAIARLVRANAAAFCAKEAEETGKPLKMAAFEIEACAQYFEYYGGLATAIQGETINLGPSYHAYTTREPFGVVGVILPWNSPLNQAGRAIAPALVSGNTVVVKPSEFTSVTMLQFAELVVKEAGLPPGVLNVVTGTGKETGEPLVKHPLIRKVAFTGSVRAGREIGKLAADRIIPLSLELGGKSPNIVFEDADLDRAVAGSVFAFTVNTGQVCLAGTRCLVHESIFEKFSKKLAGAVEALQFSDGESFGLGPLTTKAQFEQVHRYNELAIQEGAHCLVGGEAPSDKTGWYVRPTVYTNVNNSMRIAREEIFGPVLVLIPFKDENEAVAIANDSDYGLAAGVWTTDLARAHRVSAQIEAGQVYVNEYPSGGVETPFGGFKQSGHGREKGIEALHHYTQTKTTIIRI

SEQ ID NO: 9000 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 9001 - protein, 168 aa, Glycine max
MSTLPSSTFPNSNLSLSTSLSSQKLPLFHTLFPKPLPFPHLRIQTPPPFLPPLLCKSPEGTEADEAAPPPEEDEWLQKLPEKSKPLYSHSLPCIEAWLRSLGFCQSKEDRALWVVHKPDWHAQLSLDVTDLYIRYLKSGPGNLEKDVERRFSYALSREDIENAVLGGP

SEQ ID NO: 9002 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 9003 - protein, 359 aa, Streptococcus pneumoniae R6
MICSDSSYSFHNKNFMIFIRRKSLMVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 9004 - protein, 249 aa, Zea mays
MDLLDAGHRHSSELPAAGADMEGASVLPLSGAAYQPYVSELLSFSIERLHKEPELLRVDGERVRRQMQEVAVENYAAFIAASEALSFVRAQLEGFDKHLEALVEEIPNLTSGCTEFVESAHQILEERKLNQTLLANHSTLLDLLEIPQLMDTCIRNGNYDEALDLEAFVSKISKLHPDLPVIQGLAAEVKKTIQSLISQLLQKLRSNIQLPECLRIVAHLRRIGVFSESELCLQFLVREAWLSGILDDL

SEQ ID NO: 9005 - protein, 352 aa, Azoarcus sp. EB1
MTYVQDGNKSELRKAKRQLVTVIDLNKCLGCQTCTVACKNIWTKRPGTEHMRWNNVTTYPGKGYPRDYERKGGGFLRGEPQPGVLPTLIDSGDDFQFNHKEVFYEGKGQTVHFHPTSKSTGKDPAWGYNWDEDQGGGKWPNPFFFYLARMCNHCTNPACLAACPTGAIYKREDNGIVLVDQERCKGHRHCVEACPYKAIYFNPVSQTSEKCILCYPRIEKGIANACNRQCPGRVRAFGYLDDTTSHVHKLVKKWKVALPLHAEYGTGPNIYYVPPMGARGFGEDGEITDKTRIPLDVLEGLFGPEVKRVLAVLHTERENMRAGRGSELMDLLISKKWSDRFGGLTNDPLTQS

SEQ ID NO: 9006 - protein, 469 aa, Porphyra occidentalis
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLQSDTDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 9007 - protein, 488 aa, Vaucheria bursata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLDTKLEINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVETATQSK

SEQ ID NO: 9008 - protein, 583 aa, Zea mays
  unsure (1)..(583): unsure at all Xaa locations
ATYTRCSATTTVPQASSSGRPGPEEHPSLVVAAAANIRHGARGRRACRSLSALDAAKTQWYHFTAIIVAGMGFFTDAYDLFCISLVTKLLGRIYYTDTSKDSPGSLPPNVAAAVNGXVAFCGTLAGQLFFGWLGDKLGRKSVYGMTLMVMVICSVASGLSFGHTPTGVMATLCFFRFWLGFGIGGDYPXLSATIMSEYANKRTRGXAFIAAVFAMQGLRASSPGGIVTLVISAAFRAAYPXPAYRDDHFTSTVXQADIVWRVIVMLGAAPALLTYYWRMKMPXETARYTALVAKNAKQAAADMSKVLHTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 9009 - protein, 424 aa, Glycine max
IDSSRDRTSIDDFEIIKPISRGAFGRVFLAKNRTTGDLFAIKVLKKADMIRKNAVESILAERDILITVRNPFVVRFFYSFTCRENLYLVMEYLNGGDLYSLLRNLGCLDEEVARVYIAEVVLALEYLHSLRVVHRDLKPDNLLIAHDGHIKLTDFGLSKVGLINSTDDLSGPAVNGTSLLEEDETDVFTSADQRERREKRSAVGTPDYLAPEILLGTGHGFTADWWSVGVILFELLVGIPPFNAEHPQIIFDNILNRKIPWPAVPEEMSPEALDLIDRLLTEDPNQRLGSKGASEVKQHVFFKDINWDTLARQKAAFVPASESALDTSYFTSRYSWNTSDGFVYPASDVEDSSDADSLSGSSSCLSNRQDEVGDECGGLTEFDSGTSVNYSFSNFSFKNLSQLASINYDLTKGWKDDPATNSSA

SEQ ID NO: 9010 - protein, 258 aa, Rhodospirillum rubrum
MFMCPSRQNFHGGFRGSQGPNPSHPSGDAVMTRAIRIAPSLLSADFAFLGRDAQAMADGGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALRKRIDDAGLPVAIEVDGGVNPANARALGAAGADILVAGSAIFGASDRAKAIASIRGAAESGLGQEAA

SEQ ID NO: 9011 - protein, 177 aa, Chlorobium tepidum TLS
MPIKSRIRTVPDYPKKGIMFRDITTLIKDPVGFRLVIDNMTQHYLSNGVDFDAIVGIESRGFILGGALAYTLGKGFVPVRKPGKLPADVVQLEYELEYGTDKIEMHTDALVQGQRVLLVDDLLATGGTALAAAGLVEKLGGVVASMAFIVNLPDIGGEKKIREKGYNIYFLTEFEGD

SEQ ID NO: 9012 - protein, 361 aa, Listeria monocytogenes EGD-e
MKITTASHGGNYNELAKQHGLTKEMVLDFSANINPLGVPASLKQTITANLDKLVEYPEPDYLALRARIASFHQLDLANVIPGNGATELIFGIAKVTKAQKVLLLAPTFAEYERAFFDAEIVYAELTKETNFAAVEIVLEILERDTEIEAVCLCNPNNPTGQLIAQQEMIKIADLCEKRNIYLIIDEAFMDFLEENETISMINNLERFPHVAIIRAFTKFFAIPGLRLGYLLTKNDLLAEALMQMREPWSINTFADLAGQMLLEDEAYIRQTFDWINEERDFLYRGLSRFSALTVYRPTVNYIFFHLEKPLDLRKELLLKGIFIRSCANYRGLTENYYRVAVKSRADNSQLLTALEVIFSGN

SEQ ID NO: 9013 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 9014 - protein, 372 aa, Triticum aestivum
SAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFPDRNSWDVFAEILEKANVVTTPGSGFGPGGEGFVRVSAFGHRENIIEAARRLKQLYK

SEQ ID NO: 9015 - protein, 333 aa, Thermoanaerobacter tengcongensis
MKLKGGRIVTMEFSKEKLLWMYKKMVQIRQFELKTDELYKKNMIWGTYHLYVGEEAAAVGACAALEPTDYITSTHRGHGHTIAKGADLKRMMAELLGKETGHCKGRGGSMHIADIFTGHLGANGIVAGGIPIATGAALASKLRGDKRVTLCFFGDGAANTGAFNESLNMAAIWQLPVVYFCENNQYAMSAPVNKFTAVKNIADRAASYNMPGVIVDGNDVLEVYKAVKEAVDRARKGEGPTLIEAKTYRWFGHSKSDPRVYRTREEEEEWKKKDPIKRFAEKLLSEGVATEEELKKIDEEVAKEIEEAYQFAVESPEPKVEDLAKYVYAEEGE

SEQ ID NO: 9016 - protein, 307 aa, Scrippsiella trochoidea
RIGRLVFRAAMGNPDVAVKAVNDPFMDLKYMVYQLKYDSVHKQFAGTIAAKEDGGKEFLVVNGVEIQIFHEKDPAAIPWGDAGAEYVCESTGVFTAKEKAELHLKGGAKKVIISAPPKDSVPIYVVGVNHKEYKATDTVVSNASCTTNCLAPLTKVVHEKFGIVEGLMTTVHAMTATQLTVDGPSRGGKDWRGGRCASQNIIPSSTGAAKAVGKVLPAVNGKLTGMAFRVPTPDVSVVDLTCRLEKPAKYDEIVAAVKEYAAGDMKGVLDWTDEEVVSTDFVSCKSSSIFDVGAGISLNDTFVKLVT

SEQ ID NO: 9017 - protein, 471 aa, Oryza sativa
MPQYQELPCGGQVLDIDTALKDGILGGGPELGDAAAGDGGKQPVELRKMMDELDAAGDGGGDEAVPAVFICPISLEPMVDPVTLCTGQTYESANISRWLALGHRTCPTTMQELWDVTPIPNTTLRQLIAAWFSRRYTRFKKRSADFHGRAAELVHALRGTAVPKRQPLKGQARVAALRELRSLAAAHQSVTKAIAEAGGVGLLTSLLGPFTSHAVGSEAVAILVSGVPLDADAKAALMQPAKVSLLVDMLNEGAVDTKINCVRLIRILMEEKGFRPDTVASLSLLVGVMRLVRDKRHPDGVAAGLELLNSICAVHKPARSLIVSIGAVPQLVELLPELPTECVEPALDILDALAAVPEEWVRTRAETASVRTAQAVHHELHIDGGMYMQIDEDFGQLNKHSRLGGANSRELPVKVDNNTKHSFSWIASTSTLTGKAGYAQYFFPLYVANRKADDGCWCRTIDLWNGSRMRK

SEQ ID NO: 9018 - protein, 705 aa, Ajellomyces capsulatus
MPSGQKGPLDRRHDTLSDPTDQFLSKFYIDDEQSVLTTDVGGPIEDQHSLKAGNRGPTLLEDFIFRQKIQHFDHERVPERAVHARGAGAHGVFTSYNNWSNITAASFLNAAGKQTPVFVRFSTVAGSRGSVDSARDIHGFATRLYTDEGNFDIVGNNVPVFFIQDAIQFPDLIHAVKPQPDSEIPQAATAHDTAWDFLSQQPSSLHALFWAMSGHGIPRSMRHVDGWGVHTFRLVTDEGNSTLVKFRWKTLQGRAGLVWEEAQALGGKNPDFHRQDLWDAIESGRYPEWELGFQLVNEADQSKFDFDLLDPTKIIPEELVPFTPIGKMVLNRNPKSYFAETEQIMFQPGHVVRGIDFTDDPLLQGRLYSYLDTQLNRHGGPNFEQLPINRPRIPFHNNNRDGAGQMFIPLNTAAYTPNSMSNGFPQQANRTHNRGFFTAPGRMVNGPLVRELSPSFNDVWSQPRLFYNSLTVFEKQFLVNAMRFENSHVRSETVRKNVIIQLNRVDNDLARRVALAIGVEPPSPDPTFYHNKATVPIGTFGTNLLRLDGLKIALLTRDDGSFTIAEQLRAAFNSANNKVDIVLVGSSLDPQRGVNMTYSGADGSIFDAVIVVGGLLTSASTQYPRGRPLRIITDAYAYGKPVGAVGDGSNEALRDVLMAAGGDASNGLDQPGVYISNDVSEAYVRSVLDGLTAYRFLNRFPLDRS

SEQ ID NO: 9019 - protein, 506 aa, Triticum aestivum
MAAPPAIPRRGLFIGGGWREPTLGRRIPVINPATEDTIGDIPAATAEDVELAVAAARSAFLLDGGSRWARASGATRAKYLNAIATKIKEKISYLALLETVDSGKPKDEAVADMDDVAACFEFYAGLAEALDGKQHAPISLPMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 9020 - protein, 276 aa, Oryza sativa
  unsure (1)..(276): unsure at all Xaa locations
MLRFLLVWSRMTEEATSGDASPPNVKTMSLIARQAFEIDEYVRISDILHKRFARFDRRQWREAYKALLLLEHLLTHGPRSVALEFQRDREVIEQMVSFQHIDEKGSVSILRPDSIISSPDVLSPFFLITDGFFLNPSCSFNWGMTVKSKSERVLRLLERGPFLEDERERXARKIAHEDQGXFGSFNLSSADASGXSAAAALRAGAMEHQCYGRSNSRYEGXWRREACVDDGDKEXLLVVSMAEAKAEAAAEEPHHYHHPFYGFGQQRPEAMLLLSQ

SEQ ID NO: 9021 - protein, 453 aa, Eremothecium gossypii
MWRARTMASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 9022 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 9023 - protein, 365 aa, Microbulbifer degradans 2-40
MNETTLFPAGVLTGDDVQRVFKHAKENGYALPAVNVTSSSTVNAVLEVARDLNTPIIIQFSNGGAAFYAGKGLKNVNQQGSIAGAIAGAKHVHQVAKEYGVSVMLHTDHAAKQLLPWIDGLLDAGEEFYAQTGKPLFSSHMLDLSEEPLEENIATCKAYLERMAKMDMTLEIELGVTGGEEDGVDNTDVDSSKLYTQPEEVAYAYEQLSEVSPRFTVAASFGNVHGVYSPGNVILRPEILKNSQAFIAEKYNTGANPVDFVFHGGSGSDLKDIREAISYGVIKMNVDTDLQWAYWDGVKSYYEQRMEYLQAQIGNPEGANKPNKKYYDPRQWIRSGEESFADKLKSICEDLGCAQANPVSEAQIA

SEQ ID NO: 9024 - protein, 436 aa, Schizosaccharomyces pombe
TESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELSRRVLFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 9025 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDA

SEQ ID NO: 9026 - protein, 671 aa, GIBBERELLA ZEAE PH-1
MDDSATYGSPGNGASPNSNPILAQPPLQADSGAGDNEDIQMSEGLGLDATIKQDSTTPAPARGDEEMNDAPSDETKPKEDGAAGTDGQETKTKEVVESAAREHLMTQTHAIVLPSYSTWFDMNAIHEIERKAMAEFFNNRNRSKTPAVYKDYRDFMINTYRLNPVEYLTVTACRRNLAGDVCAIMRVHAFLEQWGLINYQVDADQRPSHVGPPFTGHFKIICDTPRGLQAWQPSADPVVLEGKKSQDTDQKAAAATPAKAEQNLEIGRNIYEANAKSSLISKTEGKTNGETPTTNGIPGAEDATKAPIAKVHCHQCGNDCTRIYYHSNHTDANPKAKYDLCPNCFTEGRLPANHNSSMYVKMENPTYTSTLDRDAPWTDAEILRLLEGLERFDDDWGEIAEHVGTRTREECVLQFLQLDIEEKYLDSEAPINAPTGLSMLGPQQGQLPFSQVDNPVMSVVGFLASLADPASTAAAANKSAEELKRKLRKQLDGDKADDESQSNGDSKAKSDSMDIDLRQETTTTTTTTTTTTKTNALASIPLASIGARAAGFASHEEREMTRLVSAASNVTLQKLELKLKYFDEMEEVLRAERRELERARQELFLDRLTFRRRVREVQEGLKNAAAVGGEQGMRLAQDAMNDGDRLSFQAAPGASAVPPPSSDGQIKSYEA

SEQ ID NO: 9027 - protein, 420 aa, Agrobacterium tumefaciens str. C58; identical to SEQ ID NO: 451

SEQ ID NO: 9028 - protein, 118 aa, Glycine max
  unsure (1)..(118): unsure at all Xaa locations
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKXNGERE

SEQ ID NO: 9029 - protein, 166 aa, Zea mays
  unsure (1)..(166): unsure at all Xaa locations
GDPRGRCNTHDDTQKIGEKYSNSNIEIHTFNQSQYPRIGTEDFLPLPSKGKSGKEGGDPPXHGDVCPSLSNRGKLDILLGQGKGGVFVANSDNWGAIGDIKILXHLINNQNEYCVGVTPKTLGEVKGRALISYXEEXSXLLGIAQXPEEHVNEFKSIERCKIFNTN

SEQ ID NO: 9030 - protein, 437 aa, Corynebacterium efficiens YS-314
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 9031 - protein, 308 aa, Yersinia pestis CO92
MTKKADYIWFNGEMVPWAEAKVHVMSHALHYGTSVFEGVRCYESHKGPVVFRHREHMQRLHDSAKIYRMPVSQSVDELMEACRATLRKNNLTSAYIRPLVFIGDVGMGVNPPEGYNTDVIIAAFPWGAYLGAEALEQGIDAMVSSWNRVAPNTIPTAAKAGGNYLSSLLVGSEARRHGYQEGIALDVHGYLSEGAGENLFEVKDGILFTPPFTSSALPGITRDAIIKLAKDMGLEVREQVLSRESLYLADEVFMSGTAAEITPVRSVDGIQVGIGKRGPVTAKIQQAFFGLFTGETEDKWGWLDQVNP

SEQ ID NO: 9032 - protein, 386 aa, Archaeoglobus fulgidus DSM 4304
MFKLADRLEKIPPYLFAEIDAMKRKKLQEGVKVIDFGVGDPDLPTPEHIVEALKNAAEKVERQKYPSYEGMLSFRESVARFYRRRKGVNLDPESEVISLIGSKEGIAHLPLAFVNDGDYVLVPEPGYPVYYSSTLLADGVPYEMPLKEENKFLPDFQLIPDEIARKAKIMFLNYPNNPTAAVAPKEFIKEAIDFCIDNKIILAHDAAYSEITFDGYKAPSFLEFEDAFEVCVEFNSLSKTYNMTGWRIGFACGNRDILAGLLKVKTNVDSGVFEAIQEAAIAAMDGPDRVIEENCKVYQRRRDLLVEGLRDVGIDAEKPKATFYVWAKVGGSSIEFVKQLIDKAGIVATPGIGFGKSGEGFVRFALTRGEGVIEEAIDRLKTILHK

SEQ ID NO: 9033 - protein, 126 aa, Oryza sativa
  unsure (1)..(126): unsure at all Xaa locations
TRPFRSMDDDEVFSYAKXVSAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 9034 - protein, 424 aa, Glycine max
LLCTDCFHDGRFVIGHSSIDFVRVDSTRDYGELDGDNWTDQETLLLLEAMEIYNENWNEIAEHVGTKSKAQCILHFLRLPMEDGKFENINVPSLSLSSNAINRDDSGRLHCYSNGVTAGPVYQTRDSDHRLPFANSGNPVMALVAFLASAVGPRVAASCAHAALAVLSEDNSGSTSQLEAPGHDNRTNSESIHYRDGGPHQETAVSNHNEDKAKVHGSWGIYEGRTTPLSAEKVKDAAKAGLSAAAMKAKLFSDHEEREIQRLCANIVNHQLKRLELKLKQFAEIETLLMKECEQLERTKQRIAADRSRMMSARLGTVGATPTMNASGVGTSMASNGNNRQQIISASSSQPSISGYGNNQPVHPHMSFAPRPSMFGLGQRLPLSMIQQSQSASSTAMFNAPSNVQPTTNHPLLRPVSGTNSGLG

SEQ ID NO: 9035 - protein, 124 aa, Zea mays
MSVSMNMRQNSVSTPIRRTTNPFDSDSDSEVPSRPSRAQSAPTQHTNQSVQELEDYTLRKAEETSSKANDCVRGAEAIREDATQILLTLHRQGEQITHTHRVRADIEHDLTMSEKLLGKLGGIF

SEQ ID NO: 9036 - protein, 424 aa, Glycine max
MGVIDFYNTGALCWVKSNANLKQQVGLAPRPICSFEGNNQRKFVAMASTVPVEQVNNGPLQVTGDSFIREHLRKLAPYQPILPFEVLSARLGRKPEDIVKLDANENPYGPPPEVMEALGSMQFPYVYPDPESRRLRAALAHDSGLEAEYILAGCGADELIDLIMRCVLDPGDKIVDCPPTFTMYEFDAAVNGALVIKVPRRPDFSLNVEQIAEVVKQEKPKCIFLTSPNNPDGSIIDDEVLLKILELPILVILDEAYIEFSAIESRMSWVKKHDNLIVLRTFSKRAGLAGLRVGYGAFPLSIIEYLWRAKQPYNVSVAAEISACAALQNPTYLENVKNALLKERGRLYDLLKEVPFLRPFPSHSNFILCEVTSGKDAKKLKEDLAQMGVMIRHYDKKELKGYVRVTVGKPEQTDTLMKCLKRLS

SEQ ID NO: 9037 - protein, 307 aa, Antirrhinum majus
MEILAPSSYFSSSSWFLEESRSTTRWTAAENKAFENALAVFDENTPNRWERVAERVPGKTVGDVMRQYKELEDDVSSIEAGFVPVPGYSTSSPFTLEWGSGHGFDGFKQSYGTGGRKSSSGRPSEQERKKGVPWTEEEHKLFLMGLKKYGKGDWRNISRNFVITRTPTQVASHAQKYFIRQLSGGKDKRRASIHDITTVNLSDNQTPSPDNKKPPSSPDHSMAQQQTSSTSIHKLPFQWDQTSNETIMGFASSGHHGNMFQSNPFGMNSYGFKMQGQQMQRGGFCDTYLGSQNMAFQMQSGLHFPNA

SEQ ID NO: 9038 - protein, 434 aa, Staphylococcus aureus subsp. aureus Mu50 [sequence omitted]

SEQ ID NO: 9039 - protein, 330 aa, Oryza sativa
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 9040 - protein, 343 aa, Arabidopsis thaliana
MGEDAISGNLKNLTIDTRDSETLVVCFGEMLIDFVPTVGGVSLAEAPAFKKAPGGAPANVAVGVSRLGGSSAFIGKVGDDEFGRMLADILRLNNVDNSGMRFDHNARTALAFVTLRGDGEREFLFFRHPSADMLLLESELDKNLIQKAKIFHYGSISLIEEPCRSTQLVAMKIAKAAGSLLSYDPNLRLPLWPSEEAARKEIMSIWNLADVIKISEDEITFLTGGDDPYDDDVVLQKLFHPNLKLLVVSEGPNGCRYYTQEFKGRVGGVKVKPVDTTGAGDAFVSGLLNSLASDLTLLKDEKKLREALLFANACGAITVTERGAIPAMPSMDAVQDLLSSTRS

SEQ ID NO: 9041 - protein, 766 aa, Oryza sativa (japonica cultivar-group)
MTWNKAPAADAEAGGGGDTGHARLRELGYKQELKRDLSVLSNFAFSFSIISVLTGITTLYNTGLSFGGPATMTFGWFVAGAFTMTVGLSMAEICSSFPTSGGLYYWSARLSGKRWAPFASWITGWFNIVGQWAVTTSVDFSLAQLIQVIILLSTGGNNGGGYMASKYVVIAFHAAILLSHAAINSLPITWLSFFGQFAAAWNMLGVFVLMIAVPTVATERASAKFVFTHFNTENNAGIHSNFYIFVLGLLMSQYTLTGYDASAHMTEETKNADRNGPIGIISAIGISIIVGWGYILGITFAVKDIPYLLNPENDAGGYAIAEVFYLAFKSRYGSGIGGIICLGIVAVAIYFCGMSSVTSNSRMAYAFSRDGAMPLSSVWHKVNKHEVPINAVWLSALISLCMALPSLGSLVAFQAMVSIATIGLYVAYALPILFRVTLARKHFVPGPFNLGRCGVAVGWAAVLWVATITVLFSLPVSYPVTKDTLNYTPVAVGGLFLLWEMEESSSMIGGVSGGRRSITEEQAAGAEAEADEEELEPLFDYSRVQPTMAFSFDDTDIEKSDIFVHCNKRRKVADGDGDANADEKGDKGEQKAAKAAAVVDLGEEDWLPPPPPPKPKSTVTDESEQSSVLKELRYKPVHGSILLQKQAMAKFAESADDFLEKLAQTARQKVEARIPTEHIDLDKSPERHEAREKVVVTVQDKAGHHQFRLYKDEKFGKLFRAYAKKVNLSVADLTFAFDGDKVDAESTPEDLGLEDEDMVEVLHKTR

SEQ ID NO: 9042 - protein, 388 aa, Escherichia coli
  unsure (1)..(388): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIAXDRDSVTLVHKGNIMKFTEGAFKDWGYXLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 9043 - protein, 99 aa, Zea mays
MMSDENANGTPGEQAPANSEHLNIKVTDNNNEVFFKIKRTTKLEKPMGAFCERQGKATSSVRFLFDGTRVQPTDTPDALEMQDGDTLEVHQEQVGGSSL

SEQ ID NO: 9044 - protein, 318 aa, Diospyros kaki
MESFPVINMEKMNGEERAATMGLINDACENWGFFELVNHGIPPELMDTVERVTKAHYKKCMEQRFKELVASKALEGIQAEVTDMDWESTYFLRHLPQSNISEVPDLDEEYRRVMKDFAERLEKLAEYLLDLLCENLGLEKGYLKKAFYGTKGPNFGTKVANYPPCPKADLIKGLRAHTDAGGIILLFQDDKVSGLQLLKDDQWIDVPPMKHSIVINLGDQLEVITNGKYKSVLHRVVAQTDGTRMSIASFYNPGNDAVIYPAPALVEKEVEEKEVYPKFVFDDYMKLYAALKFQAKEPRFEAMKAVEANVNLGPIATV

SEQ ID NO: 9045 - protein, 310 aa, Pseudomonas aeruginosa UCBPP-PA14
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPDRDPGEVARGWLNPRCRLVFVTHGGAGASVHCTHGSWSRPADTALALRDTVGAGDTFQAATLAYLRRLDADSPAGLAALSREAIDAMLAFAIRAAAVTCSRVGPDLPFAHEL

SEQ ID NO: 9046 - protein, 1579 aa, Saccharomyces cerevisiae
MSHSDYFNYKPYGDSTEKPSSSKMRQSSSSSSSRLRSESLGRNSNTTQARVASSPISPGLHSTQYFRSPNAVYSPGESPLNTVQLFNRLPGIPQGQFFHQNAISGSSSSSARSSRRPSNIGLPLPKNPQQSLPKLSTQPVPVHKKVEASKTESEIIKKPAPVNSNQDPLLTTPTLVISPELASLNTTNTSIMSTPQNITNQTSNKHIPTRSQPNGSTSSSTLQDIVTTNSSQRSVGHHGGSTTSLRTYKKQYVLNEQLYLRKMRNRANDDYYTRGIVASSNFEDDEENFSNKGEDDLELEMDDLLKVEGEDKDNDFNFGYNFITSSTKNNENVVSMSLNYLKGKLDWLRDVNNDQPCEIEDEEWHSILGSEDLLSKLLQNPMVNNRFEWQTMLSKVLKGDIVRNEKTKIANQGKGPGFNTQFSDDIWIELKAWMNGRTVEDQNKSLRIFRDSTDSVFQEIMAFKLEDNMSADEAAETIKSLVDKYYRVLNLWPNIKRMHAEKPITKTEAFRNRIDTLNSWLNFKFNFDTNIAYLKKWIVGNKELESTTEVDNTTVNLDDPAVFATNCKRFAEQIMKEKDIELIFQKKIFFPLAPWILKAKFFFLKYQKTWNELNLSYLDQDLEFLLMFPMRLVKDIILIRLSYAKKIQNPTLMMIDQMMDDFSTYIKLAVQMKFTVASYCNDWFFKVKIDPEFDHTVVEGLEYFFSILELRILYSGKNSFKTSKEPDLLLKYWEMFRNVGYYIDDAGELIAAEFTKLTLRLVHRLHAYLLRQQNTPPKLENEAAAEKWLVQIFEILGSMKRKLNRFTNILTKAFQNFVRYKIEDHNYLLKQLKETGHFLIYTGGYLEQNGTYLIGSPELLGCKDDDILRIIKNSDIGCDLVPKLEINNSLTIYNALDDNWNSNSSLGSDISNDGTPFYYIKNDLTTQPRSYNGNRVNREPDFENSRSTEEEFYELETRLNSLGYVLVLTPQEPLLWEGEMYNLSDNKTIKPEGLNLKVIPNSIDLMCQGSSYALEYQCDRFQQISGSSVSFLEKKSSSETVKNNLQRINKAYFRCTYSVLKNYTKIVTTFKKVSPVNDLLNNIFLFGRDFGLNFLRINVANNEKRSIIILLMMRLSIGWLKFLAEDCDPTDQRVFRWCVTSMEFAMHMVSGWNILALDECQFSSLKQKISECMSLLISHFDIIGARSIEVEKINQQARSNLDLEDVFDDDMMLQVNSEFRVQSIMELEERIKRNPHQTGKVIDDSDKGNKYLVSLASSISNVSMRWQKRNFIGGGTFGRVYSAVDLDNGEILAVKEINIQDSKSMQKIFPLIKEEMSVLEILNHPNIVSYYGVEVHRDKVNIFMEYCEGGSLAALLEHGRIEDEMVTQVYTLQLLEGLAYLHESGIVHRDVKPENILLDFNGVIKYVDFGAAKKIANNGTRLASMNKIENADGEHEDVTHVSDSKAVKNNENALLDMMGTPMYMAPESITGSTTKGKLGADDVWSLGCVVLEMITGRRPWANLDNEWAIMYHVAAGHTPQFPTKDEVSSAGMKFLERCLIQNPSKRASAVELLMDPWIVQIREIAFGDDSSSTDTEERE

SEQ ID NO: 9047 - protein, 582 aa, Streptomyces ansochromogenes
MPAREGAGSPFLRESAGRFRNRRVRVPDEINLKNCGLLDSRAAAVHRATLAEFDPDDVLTYPILQPVYGMLADRFGVDTDSLVLTAGSDPGLNLLTRAFPEVSRIVLHQPNFDGWAKFAAISGCVLDPVAPDPETGLFDLRDLARRLRAGAPAFVVVTTPHSFTGQVHGREELAELADAVAEHGSLLVVDTAYLAFTEGGEELVRGLAGLRHVVRVNTFSKSYGLSGARIAVTVAHPATARHLFDLDPEGSVSAPAVALLRRSLEEQAVFTAIWADVRRLRERFAAEVERAVPGWHARPSGGNFVTWDVPDPADAGAASRHLLGRGIVVRDLSGAPGLPAAVRIRSRNETVVRRVVAALGDRYRYLRRGLLVRGPAPSPETAPALGGLGIRTVVDLRLEEERRQYRGPEYTGATVLSRPVAGDMSRIRGNVRPRPSDYLANYRDMLTRAAPVAAEIVDLLAEGAEVPVYICCAMGKDRTGVVSALVLRALGVRTADVARDYALTARAYRALRSADARPNWTREDTLAQLRLRTSTPAATMRSLIAGIEAEHGSVARMLTLHGLREETRLRTVVGAFTHPAHL

SEQ ID NO: 9048 - protein, 356 aa, Eucalyptus gunnii
MGSLEKERTTTGWAARDPSGVLSPYTYSLRNTGPEDLYIKVLSCGVCHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 9049 - protein, 117 aa, Zea mays
  unsure (1)..(117): unsure at all Xaa locations
DRTRPAFLDTIYAFVDLYKDQRITPAAGFEARGFIYXPPIALAITAKFVPLTKPIKLPRDVISEEYSLEYGTDKIYMHVGAVHANYRALVIDDLIPTGRTLCPPVKLIERVSSKVVK

SEQ ID NO: 9050 - protein, 308 aa, Oryza sativa
AIFSLLLLRSSEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRFYSLLFIVQDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRD

SEQ ID NO: 9051 - protein, 666 aa, Oryza sativa
MATANLLYAALLVPTVLYLAVTRRRSRRLPPGPVGLPLVGSLPFIDPNLHTYFASLAAKHGPILSIRLGSKVDIVVNSAQLAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRGGEVGGGVGTGGGLMEGRRWHLRAVLSAVEGAAGQRLHAAEAELGRNAEHDETPSLSGMGTGRAVASNSTGNGGGRSVGAGRATTAARAAGRSWVEMESSPACERNGASATIGGNRMVAEVQAGSVSVTVATTRRGGDSSGGGARPEMGGGRRSSGARREGGRRHGRVR

SEQ ID NO: 9052 - protein, 246 aa, Keteleeria evelyniana
YTYTLRKKGPEDVILRVLYCGICHSDLVHMHNEFGMSRYPLVPGHEVVGIVTEIGSEVKKFKVGEHVGVGFIVGSCRTCGHCNESMEQYCSKKIWSYDDVNHDGTPTQGGFASTMVVDQMFVVRIPENLSLEQAAPLLCAGVTVYSPMKHFGMTEAGKRCGILGLGGVGHMGVKIAKAFGLHVTVISSSDEKKEEALEVLGADAYLVSKDAEKIKEAAESLDYIMDTIPVAHPLDPYLSLLKTNGK

SEQ ID NO: 9053 - protein, 260 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHDPTGKVFSKEELLIISQACQKMDCFVITDEVYEYITYDANKHISLASLPGMQERTIITSSLSKTYSVTGEHNSEFAAQFVVTQPAIEIARLVR

SEQ ID NO: 9054 - protein, 394 aa, Schizosaccharomyces pombe
MKTHLLANKLYQKGLRRQNYLQICKLICHARTVLSDVSNVGKNNADEKDTKKAKRSFDESNLSTNEEADKPVESKFVKKLKVYSKNADPSVETLQKDRALMLMNHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAMYLSRRLLRRGPWTAKLVESSGGYEEHELKEIAYIMLHYHNKPLEHKAFFQKYSSKRFLKASIFVHQLVRQRYSVNRTDDDDLQSEPSSSLTNDGQRTLL

SEQ ID NO: 9055 - protein, 476 aa, Gracilaria pacifica
NERYESGVIPYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAASGEIKGHYMNVTAATMEEMYERAEFAKQLGSVIVMIDLVIAYTAIQTMAIWARRNDMILHLHRAGNSTYSRQKIHGMNFRVICKWMRMSGVDHIHAGTVVGKLEGDPLMIRGFYNTLLKTHLEVNLPQGIFFEQDWASLRKVTPVASGGIHCGQMHQLLDYLGNDVVLQFGGGTIGHPDGIQAGATANRVALESMVLARNEGRDFVAEGPQILRDAAKTCGPLQTALDLWKDITFNYTSTDTADFVETPTANV

SEQ ID NO: 9056 - protein, 405 aa, Zea mays
  unsure (1)..(405): unsure at all Xaa locations
MAAMPGGAHGAGAADPMQVDQPLPPAAAGTAHAPAXRQGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVTESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDDLREPHARLPNGRPFPPLFNFKQELANASPELINRLIPDHARRHLGLTLLPATGP

SEQ ID NO: 9057 - protein, 504 aa, Triticum aestivum
MEDTFITVCLAVALVSLLIMIAGRRRWGARGDGLRMAPGPWQLPVIGSLHHLVLAGQLPHRAMRDLSRRYGPAVLLQLGQVKTLVVSSREGAREVMKNHDTMFATRPLSTTMRVLSYGGQDIVFAPYGEYWRQLRKIAVSELFTARRVLSFRAIREEEVATAVRAVDEAAAAARPVEMRAVLSTLVTDSTARAVIGDRCRERDAFLRELDRIVQLASGFNLADMWPSSRLAAWLSGAEECRHTLYTMLDGIVEEHLQRMDGGGDHAEDLLDVLLKIQKEGGLKFPIHMDAVKAIILDVFSAGSETTTTTIEWAISELMNNPMAMQKATTEVRQAFQASGTVAEHALSELTYLRFVIRETLRLHPPLPLLFRECQEPCQVQGYDVQQGTQVLVNAWALGRDERYWPDAPEEFRPERFEEEAAKADFGGGDFAFLPFGAGRRMCPGMAFGLAGVELPLASMLFHFDWKPPGPGSAELDMTETFGLTARRTDQLLLRPVLRVPIPGV

SEQ ID NO: 9058 - protein, 251 aa, Arabidopsis lyrata
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 9059 - protein, 177 aa, Leptospira interrogans serovar lai str. 56601
MSIVKSKIRTIPDYPKPGILFRDITSLLLDPEGLALTIGTFVNRYQGKGITKVAGIEARGFLTGAPLAFQLGVGFIPIRKKGKLPSETVSEEYDLEYGKDVIEVHKDSIQPGDKILLMDDLIATGGTMIAAVKLLKKLGAEIYEAGVIIDLPDLGGRKKLQEELKVPVFSICEFEGH

SEQ ID NO: 9060 - protein, 212 aa, Streptomyces avermitilis MA-4680
MSTRILVVDNYDSFVFNLVQYLYQLGAECEVLRNDEVSTAHAQDGFAGVLLSPGPGAPEQAGVCIDMVRHCAATGVPVFGVCLGMQSMQVAYGGVVDRAPELLHGKTSLVEHTGKGVFSGLPSPFTATRYHSLAAEPRTVPDELEVTARTHDGIIMGLRHRELPVEGVQFHPESVLTEHGHRMLANWLVECGDTDAVARSAGLAPVVGRATA

SEQ ID NO: 9061 - protein, 445 aa, Sesbania rostrata
MASRPIVPQQPRGDAALGAGKQQKKNGAADGRNRKALGDIGNLVTVRGVEVKPNRPITRSFCAQLLANAQAAAAAENNKKQACPNVAGPPPVVEGVAVAKRVAPKPGQKKVTTKPKPEEVIEISPDEEVHKDNNKKKEGDANTKKKSHTYSSVLTARSKAACGLTNKPKEIIDIDAADTANELAAVEYIEDIYKFYKMVENESRPHDYMDSQPEINERMRAILVDWLIDVHSKFDLSLETLYLTINIVDRFLAVKTVPRRELQLVGISAMLMASKYEEIWPPEVNDFVCLSDRAYTHEQILFMEKIILGKLEWTLTVPTPFVFLVRFIKASVPDEALENMAHFLSELGMMHYATLMYCSSMVAASAVYAARCTLNKSPVWNETLKQHTGYSEEQLMDCARLLVSLHSTVGNGKLKVVYRKYSDPERGSVAVLPPAKNLLSEGKSL

SEQ ID NO: 9062 - protein, 357 aa, Oryza sativa
MDQSFGNLGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGGHGGSGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 9063 - protein, 382 aa, Xanthomonas axonopodis pv. citri str. 306
MPLTTKLPKVGTTIFTVMSQLAAEHGAVNLGQGFPDFAVPQRLVDELSKAMAAGHNQYPPMTGVATLRQAIAGKAQRCYGAQVDADTEITVTSGATEAIFNAIHAVVRAGEEVIVLDPAYDCYEPAIDLAGARAVHVALHPQTFAVDWDALRAAITPKTRLLMINSPHNPSGAMLSAEDMQTLTELLRGTEIFLLSDEVYEHIVFDGRRHESVLRWPALRERAFVISSFGKTYHCTGWKIGYAIAPPALTAEFRKVHQYNTFTSFGPAQHAFAAMIRDEPEHDEQLGAFYQAKRDRFREQLLATRLKPLPVPGGYFQLVDYSAISDLPDTEFVKWLTIENGVAAIPLSPFYENAPAGQRLARLCFAKNDATLDAAIERLRRL

SEQ ID NO: 9064 - protein, 388 aa, Salmonella bongori
QNGKLNVPENPIIPFIEGDGIGVDVTPAMLKVVDAAVEKAYKGERKISWMEIYTGEKSTQVYGQDVWLPAETLDLIREYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWMKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 9065 - protein, 343 aa, Atropa belladonna
MATLVSNWSTNNVSESFVAPLEKRAENDVPLGNDVPIIDLQQDHLVVVQQITKACQDFGLFQVINHGLPEKLMAETMDVCKEFFALPAEEKEKLQPKGEPAKFELPLEQKAKLYVEGEQLSDEAFLYWKDTLAHGCHPLDEELVNSWPEKPATYREVVAKYSVEVRKLTMRILDYICEGLGLKLGYFDNELSQIQMMLTNYYPPCPDPSSTLGSGGHYDGNLITLLQQNLPGLQQLIEDAKWIAVEPIPTAFVVNLGLTLKVITNEKFEGSIHRVVTNPTRDRVSIATLIGPDYSCTIEPAKELLSQDNPPLYKPYSYAEFGEIYLSDKSDYDAGVKPYKINA

SEQ ID NO: 9066 - protein, 220 aa, Zea mays
YIGIVTIYGQLTSKTLCVFRRSTNLDSWTPDQLKMMAFGGNNRAHAFFKQHGWTDGGKVEAKYTSRAAELYRQMLTKEVAKSATTDNALPSSPVASEASKPPSDDFPEFKLPDVAAPPAENLNGKHEPKSPKAAPRSPKAATHSTFATSVKKPIGAKKVGGKTGGLGVRKLTTKPNESLYEQKPEEPKPAVPALAASTKKGGQALHSRFEYVENEPSGDR

SEQ ID NO: 9067 - protein, 226 aa, Candidatus Blochmannia floridanus
MKRDMKEYLIEPSILAADFSKLGEDVSNVISAGADVLHFDVMDNHYVPNLSIGPMVLKSLRNYGIDIPINVHLMIKPINDRLILDFLEAGATGISFHPESTDHVDRFLQLIKEHGCKTGLVLNPSTDLSCLEYVMHKIDVIILMSVNPGFGGQIFLPEILRKITQTRKLIDNNPYDINLAVDGGINMSNFCKICESGANVFIIGSAIFNASNYHDVIYNFRSMLLY

SEQ ID NO: 9068 - protein, 533 aa, GIBBERELLA ZEAE PH-1
MGVVEALLEQVTLKTTLVILFVSYCIYSIICRIDEHRRIRRLGHYGPHMKTYAPWGLGIVARFVVSTVKHQNLATWRDDMFGAENSWTVETRLLGVRTIFTADPANLKAILATQFVDYGKGKPFHAEWKDFLGDSIFTTDGAPWHASRQLIRPQFTRDRVSDLHCFEAHMQTLFKAIANRGPLHGEDQPVPTEGLDGKVLDISDLFFRYTLDVATEFLLGWDVKSLTTPRQEFAEAFNDVQRIQNIVARTGKLRHIIPRYKFWKGLKTVNHFINFYIERALRLSPEELNSKTKDDHSYTFLHALAGFTRDRKVLRDQIIAVLLAGRDTTAATLSWTLYELGRYPNAVKRLRSEILSTLGSERTPTYDDLKSMSYLKAVLNETLRLYPAVPFNVRLALKDTTLPRGGGPDGSEPLPVLKDSPVGYSTLVMQRRSDLYPPISDTFADPQIFSPERWAHWHPKPHDYIPFNAGPRICIGQQFALTEMSYVLCRLFQKYERVESRMKDIDGGEPLLKADIVLSPGQGVNVAFWEAKK

SEQ ID NO: 9069 - protein, 431 aa, Bacillus anthracis str. A2012
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 9070 - protein, 473 aa, Zea mays
MATTAVSVDEKLDKLRAEVAKLDQISENEKSGFISLVSRGLSGDFFQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 9071 - protein, 478 aa, Streptomyces avermitilis MA-4680
MASAFEYAPAPESRSVVDIAPSYGLFIDGEFTEAADGKVFKTVSPSTEEVLSEIAQAGEADVDRAVKAARKAFEKWSALPGSERAKYLFRIARIIQERSRELAVLETLDNGKPIKETRDADLPLVAAHFFYYAGWADKLDHAGFGANPRPLGVAGQVIPWNFPLLMLAWKIAPALATGNTVVLKPAETTPLSALFFADICRQAGLPKGVVNIIPGYGDAGAALVEHPDVNKVAFTGSTAVGKAIARQVAGTEKKVTLELGGKGANIVFDDAPIDQAVEGIVTGIFFNQGQVCCAGSRLLVQESVQDELLDSLKRRLSTLRLGDPLDKNTDIGAINSAEQLSRITSLVDQGEAEGAERWSPACELPSSGYWFAPTLFTNVTQAHTIARDEIFGPVLSVLSFRTPDEAVAKANNSQYGLSAGIWTEKGSRILAVASKLRAGVIWANTFNKFDPTSPFGGYKESGFGREGGRHGLEAYLDV

SEQ ID NO: 9072 - protein, 207 aa, Triticum aestivum
  unsure (1)..(207): unsure at all Xaa locations
LDVSPTTTLSSSPSPPARASQQAVRPSKRVRSGXPGTASGXGGGGSGGGSAXGGGSYPMCQVDDCRADLTSAKDYHRRHKVCEIHSKTTKAVVGNQMQRFCQQCSRFHPLSEFDEGKRSCRRRLAGHNRRRRKTQPTDVASQLLLPENQENAANRTQDIVNLITVIARLQGACAPTLPGTPPLPDLDLLALFSGSVFSGDNANSLAK

SEQ ID NO: 9073 - protein, 297 aa, Zea mays
MTTATQKPFPRVLSCQASSLLSWTAPIHRPPRLYPNSMWRLKIGEGGPWLKSGNGHIGRETWEFDEDFGSEADREAVDSAREEFRKNRLRMRHSSDLLARMQIAKENGFSHDLHKTRDDDGRSPLLVATATGSSTVSETLRKALDYFAAIQAHDGHWPGDFPGPLFTTATMITVLYVTGSLDSTLSSEHRREICRYLHNRQNADGGWGLHAEGESSMLSTALNYTALRLLGEGGDGGGGPGMSSSSMLIRARKWIRDRGGATMIPILGKVWLSVTTDRPPSYPLLLLHAAAAGLLDY

SEQ ID NO: 9074 - protein, 362 aa, Triticum aestivum
  unsure (1)..(362): unsure at all Xaa locations
NSPPSDSHGHSPNKHNRKFSTQQLTRSHSLALTSKQREHPPLPCLTGPSAADYLPFKFATAERDLTLLPCVRVRRHQLKGKLLWIRGASGGIGGVHGSMFDKKYKLYQPYRMAHERVXRNIISNDAESKVEVLPLDLSFDXESLKEVVHSAESLFSRTGIDYMMHNAAFERPKRGALEETEEGLKATFHVNVFGXTITLTRLLAPFMLDRGMGHFVVMSSAAGXVPTPGQALYSASKHALNGYFASLRSELCTKGIKVTVVCPGPIETPVPSGATSSSQRHSSEKRVSVERCAELTIVAATHGLKEAWISYQPVLAVMYVVQYMPTIGWWLMDKVGAKRVDAAAKKGNAYSWNLLFGGKKSA

SEQ ID NO: 9075 - protein, 304 aa, Shewanella oneidensis MR-1
MPETALLEEVVDRVRPLLGQGKVANYIPALANIDPGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSKAMLYLANRGKTLDGTELISQVQTRQLNALLATSGLYDGAGEFAYRVGMPGKSGVGGGIIAVIPGELSVCVWSPELDTQGNSLAGTAMLEQLSQRLGRSIF

SEQ ID NO: 9076 - protein, 419 aa, Polyopes lancifolius
ETDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGIDYVTEGPQLLQNAAKTC

SEQ ID NO: 9077 - protein, 466 aa, Glycine max
  unsure (1)..(466): unsure at all Xaa locations
MNKSILLLLLFFLLNPSLLATSHPLNPIPVTLSVADFGAAGDGLRYDTEAIQSAINSCPEGDPCHVTFPAPGKYLTATVFLKSGVVLNVESGATILGGTRLEDYPEESWRWYVVVAENATDVGIRGGGAVDGQAAKFVVREDPRKNVMVSWNQTGACLGDECRPRLIGFLDCNNVXVSNITLNQPAYWCLHLVRSNNICIQDIAIYGDFNIPNNDGIDIEDSKXTVITRCHIDTGDDAICPKSSTGPVYNLTVTDCWIRSKSSAIKLGSASWFDFKHFVFDNIAIVDSHRGIGFQIRDGGNVSDIVFSNMNISTRYYDSLWWGRAEPIYVTSCPRDSSSKEASISNVLFINITANSENGIFLSGSKRGLLRNLRFIDMDITYRRFTNYAGGLLDYRPGCQELVKHRTAGIMMEHIEGLEVKNVEMRWSNDQLEQWNNPLEFRPSTVNNISFLNFNSGLYTNSKSNY

SEQ ID NO: 9078 - protein, 497 aa, Pseudomonas fluorescens PfO-1
MTTLTRADWEQRARDLKIEGRAYLNGEYTDAVSGETFECISPVDGRLLGKIASCDADDAQRAVENARATFNSGVWSRLAPTKRKATMIRFAGLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAELAVEAGIPKGVLNVLPGYGHTVGKALALHNDVDTLVFTGSTKIAKQLMIYSGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDTAEEAINIANDTPYGLAAAVWTQDISKAHLTAKALRAGSVWVNQYDGGDMTAPFGGFKQSGNGRDKSLHAFDKYTELKATWIKL

SEQ ID NO: 9079 - protein, 499 aa, Beta vulgaris
LHLRPTPTAKSKALRHLPNPPSPKPRLPFIGHLHLLKDKLLHYALIDLSKKHGPLFSHYFGSMPTVVASTPELFKLFLQTNEATSFNTRFQTSAIRRLTYDSSVAMVPFGPYWKFVRKLIMNDLLNATTVNKLRPLRTQQIRKFLRAMAQGAEARKPLDLTEELLKWANSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHTKGLVVDFFSAGTDSTAVATEWALAELINNPKVLEKAREEVYSVVGKDRLVDEVDTQNLPYIRAIVKETFRMHPPLPVVKRKCTEECEINGYVIPEGALIPFNVWQVGRDPKYWDRPSEFRPERFLETGAEGEARPLDLRGQHFQLLPFGSGRRMCPGVNLATSGTATLLASLIQCFDLQVLGPQGQILKGGDAKVSMEERAGLTVPRAHSLVCVPLARIG

SEQ ID NO: 9080 - protein, 423 aa, Solieria pacifica
STATWTVVWTDLLTACDLYRAKAYKVDAVPNTSDQFFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPCMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLNVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 9081 - protein, 365 aa, Oryza sativa
EDAMSTGDSTESLDIDCLDDGDSEVVSSLQHLADDKLHISDNRDVAGVASKWTKHGCNSVEIDYIVDIDNNHEDPQLCATLAFDIYKHLRVAETKKRPSTDFVETIQKNIDTSMRAVLIDWLVEVTEEYRLVPETLYLTVNYIDRYLSSKVINRRKMQLLGVACLLIASKYEEICPPQVEELCYISDNTYTKDEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDGTRQLTPWDVLKAHDNEKLRASRKIVKIE

SEQ ID NO: 9082 - protein, 153 aa, Zea mays
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKN

SEQ ID NO: 9083 - protein, 414 aa, Zea mays
IFLRILAFKTNVPRNANMAKLQAGYLFPEIARRRAAHLLKFPDAKIISLGIGDTTEPIPNVITNAMAERAHTLSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCGPENGFFPDLSTVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNIAQAGGLACLSPDGLKAMQDVVGFYKENTEIIVETFTSLGFNVYGAKNAPYVWVHFPGRNSWDVFAEILEKANVVTTPGTGFGPGGEGFVRVSAFGHRENIIEAARRLKQLYK

SEQ ID NO: 9084 - protein, 185 aa, Oryza sativa
MGGRKDNHDSSNADKGFHGAYPSGYPGAYPLMQGYPNSPGQYPTPGGYPSAPPGQYPPAGGYPGAQYPPSGYPPSQGGYPPGAYPPSGYPQQPGYPPAGYPGHGHGPPMQGGGMLGGGHGAGASGYGALLAGGAAVAAAAVGAHMVRPGGGGGHGMFGHHGGKFKKGKFKHGKYGKHKKFGRKWK

SEQ ID NO: 9085 - protein, 337 aa, Ajellomyces capsulatus
MVVKVGINGFGRIGRIVFRNAIEHGEVDVVAVNDPFIETHYAAYMLKYDSTHGQFKGTIEVNSNGLTVNGKAVTFYQERDPANIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 9086 - protein, 181 aa, Methanothermobacter thermautotrophicus str. Delta H
MTDVDIKIENIVASATLGKSIDLQTVAEALENVDFNREQFPGLVYKLKEPKTAALIFGSGKLVCTGAKSIEDSKRAIKLTVDMMRTMDPDIPEEFEIKIQNIVASANLGKPLNLEAVALGLENTEYEPEQFPGLVYRLDDPKVVLLLFGSGKVVCTGAKSAEDAKLGVEKTKARLAELDLI

SEQ ID NO: 9087 - protein, 467 aa, Eucheuma denticulata
  unsure (1)..(467): unsure at all Xaa locations
PYAKMGYWDPEYVVKDTDVLALFRVSPQPGVDPIEASAAVAGESSTATWTVVWTDLLTACDLYRAKAYKVDAVPNTSDQYFAFIAYDXXXXXXXXXXXXXXXXXXXXFGFKAVKALRLEDMRIPVAYLKTFQGPATGVIVERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDFVIGYTAIQTMGIWARKNDMILHLHRAGNSTYSRQKIHGMNFRVICKWMRMAGVDHIHAGTVVGKLEGDPLMIRGFYNTLLLPYLDVNLPQGIFFEQDWASLRKVTPVASGGIHCGQMHQLLDYLGIDVVLQFGGGTIGHPDGIQAGATANRVALEAMVMARNEGRDYVAEGPQILQDAAKTCGPLQTALDLWKDITFNYTSTDTADFVETPTANV

SEQ ID NO: 9088 - protein, 505 aa, Pseudomonas syringae pv. tomato str. DC3000
MSTATILELMRPYWGDRSVIASYVGGAFIEGHGAPVEVRNAHNDSLLLSFPDADESLVEVADKAAKAAQQQWWAMTAQARGRAMYQVGNLIREEQENLAQIESLTANKPIRDARVEVLKVAEMFEYYAGWADKLHGEVIPVPTTHLNYVTYEPLGTVLQITPWNAPIFTCGWQIAPAIAAGNAVILKPSELTPLSSLVVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQQSIFEKFTNALAVAATQFKVGDPGDPETQIGPINNAKQYNHVKSMVERALKDGAKLVGEQADPIPDRPGYYINPTVLAGTNELHCAQEEIFGPVVVAIAFKDEEDAIRIANDSRFGLAGGVWTRDVGRAHRVAKQVRAGTFWVNGYKTIHVSSPFGGYGESGYGRSSGLDALREYSEVKSVWVETAAKPAASFGYGASLE

SEQ ID NO: 9089 - protein, 205 aa, Oryza sativa
  unsure (1)..(205): unsure at all Xaa locations
MSFSSSMSKQQVLEVAGDEVGGGGGEEVMELIPGLPEEVAEKCLLHLPFLYHRLFRTVSSTWNRFLTVSPAKFPSAAAASVSLSLPFLFAFAFDPASRRLQCQALDPFSRRWLLLPPVPGGAAAAGSFAVVXLPRRGEIYVIGGVVEGGDKAVRSVAVYSAARNGWEEAAGMGTARGYMAAGEVGGRLVVAGEDGEAEVFDPEEG

SEQ ID NO: 9090 - protein, 270 aa, Emericella nidulans
MATNARYEPAPQRDSFEDQHYTQAPPSYQATAQEPTPRSEDDNVPDDFKFGGTVAEGTLPIRMQFIRKVYAILTVQLLLTTVMSSISFFSPSYCEWIRSNVWLMMVSVFGAFGFLLVTYWKRKSYPANLLFLSAFTILEAYSISVVTSYYQPRIVVQALILTLGLFVGLTLFACQTKYDFTNWMPYLFGALWFLILFGFVAAFVPHGSTMELIYGSLAALIFSGYILVDTQLIMRHYHVEEEIAASISLYLDILNLFLAILRILNNQNNN

SEQ ID NO: 9091 - protein, 460 aa, Phitymorphora amansioides
  unsure (1)..(460): unsure at all Xaa locations
WDPDYVIKETDVLALFRVTPQPGVDPVEASAAVAGESSTATWTVVWTDLLTACDLYRAKAYKVDAVPNSSEQYFAYISYDXXXXXXXXIANLTASIIGNVFGFKAVKALRLEDMRIPVAYLKTFQGPATGVIVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQSMGIWSRHNDMILHLHRAGNSTYSRQKSHGMNFRVICKWMRMAGVDHIHAGTVVGKLEGDPLMIRGFYNTLLLAHLDINLPQGIFFQQDWAALRKVTPVASGGIHCGQMHQLLDYLGDDVVLQFGGGTIGHPDGIQAGATANRVALESIVIARNEGRDXVAEGPQILRDAAKTCGPLQTALELWKDITFNYTSTDTADFVETPTANV

SEQ ID NO: 9092 - protein, 170 aa, Oceanobacillus iheyensis HTE831
MEFKNYIEIVEDWPKEGIKFKDITPLMADGKAFKSAVDEIVDYANTKEIDLVVGPEARGFIVGCPVSYALEVGFAPVRKEGKLPREVIKVDYGLEYGENVLTIHKDAIKPGQRVLITDDLLATGGTIEATIKLVEQLGGIVVGCAFLVELGYLDGKDKLEGYDVLTLMKY

SEQ ID NO: 9093 - protein, 364 aa, Buchnera aphidicola (Uroleucon erigeronensis)
MKKKYRIAVLPGDGIGPEVMQEAYKILNILKDHFLLPLEMKEFNIGGIAIDQEGIALPKNTLLGCENSDAILFGSVGGKKWDYLSIDKRPERAALLPLRKHFNLFSNLRPAKLYADLKYLSPLRSNIIKDGFDILCVRELTGGIYFGKPNGHSKKNDIEYAFDTEVYYDYEISRIAHLAFQLARNRKKKVCSLDKSNVLKSSILWKEIVEKISKNYPDVHLSHLYIDNAIMQIIKDPSQFDVILCSNLFGDIVSDECAAITGSIGMLPSASLNEKNFGLYEPAGGSAPDIAGKNIANPIAQILSVSMLVRHGMNLKKIADKIDESVVSVLKQGYRTADISNNSHNYLKTSEMGDIIANFLINGK

SEQ ID NO: 9094 - protein, 187 aa, Thuja standishii
ICTYFAQPLHQRDYSRWPLKPEGWREIVDKYSEALMGLAKKMLAIVSEALGLEPDAVTKACVEMDQKVVINYYPKCPEPDMTLGLKRHTDPGTITLLLQDQVGGLQATKDDGLNWITVQPVQGAFVVNLGDHMHYLSNGKFKTADHQAVVNSNYSRLSIATFQNPSQDAIVYPLKLEEGEESFMEEP

SEQ ID NO: 9095 - protein, 476 aa, Pterocladiella bartlettii
NERYESGVIPYAKMGYWDPDYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVFEGLRGGLDFLKDDENINSQPFMRWKERFLYSMEGVNRSIASTGEIKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIKGFYNTLLLPHLDVNLPQGIFFEQDWASLRKVTPVASGGIHCGQMHQLLDYLGEDVVLQFGGGTIGHPDGIQAGATANRVALEAMVIARNEGRDYVTEGPQILRDAAKTCGPLQTALDLWKDITFNYTSTDTADFVETPTANV

SEQ ID NO: 9096 - protein, 218 aa, Olea europaea
SGQLEWQDYFFHCIYPEEKRDIWPKTPTDYSPATSEYAKQLRGLTSKILSALSLGLGLEQERLEKEVGGMEELLLQFKINYYPKCPQPELALGVEAHTDVSALTFILHNMVPGLQLFCEGKWVTAKCVPNSIIMHIGDTIEILSNGKYKSALHRGLVNKEKVRISWAVFCEPPKEKIVLKPLPETVSEAEPPRFPPRTFSQHIMHKLFRKSEDSGEEK

SEQ ID NO: 9097 - protein, 435 aa, Schizosaccharomyces pombe
MTTIQKIYSRSIYDSRGNPTVEVELTTELGTFRSMVPSGASTGEWEAKELRDNDKNKWGGKGVTIAVHNVNNIIGPALVKSDIKITDQRGIDEFMIKLDGTNDKSKLGANSIVGVSMAVARAAAAFLKIPLYEYIGKLAGSKTTECIPVPSFNVLNGGRHAGGDLAFQEFMIMPIKAPTFSEGLRWGSEVYHTLKALAKKKYGASAGNVGDEGGIAPDLTTAEEALDLVNEAIKEAGYDGKVKIGFDVAASELYNGKLYDLDFKSEHPKPENKLDYKKLYEKYSALIEKYPIVFIEDPFSEEDWGAFSYMSSKTKVEVIADDLTVTNVKRLSKAIELKCANALLVKINQIGSLSETIDAANMAKKAGWGLMVSHRSGETDDSFIAHLAVGLEAGQMKSGAPCRSERLAKYNELLRIEDNLGDSAIYAGTRAADYI

SEQ ID NO: 9098 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQE

SEQ ID NO: 9099 - protein, 279 aa, Zea mays
MNQFICSCTNTKHHGMTINGPCMVFHNANCIGRAHEEEPFKPLCRSACEPSRNSPSRNCSMGRPIRELRAKSSRPLNRLNCLVFSPSFRSNRDTDLSSKHAPYQFTSYLFRLLSAIAMSSSLYKQLGLSGAGSPLSGRHLALLVLGAGFLALTVFVVHPNEFRIQSFFSGSSCGGRPGTDAAAAAVASPHGDTTTEKEENARADDVRVLIGIQTLPSKRARRHLLRDVYSLQAREHPPVAGSVDVRFVFCNVTSPDDAVLVAVEALRYGDIIVLDCAEN

SEQ ID NO: 9100 - protein, 226 aa, Zea mays
MDLLDARHRHTPDSSSSPHAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPPLMDTCIRNGNYDEALDLEAFVSKISKLHPDLPVVQGLAAEVKKTVQSLISQLLQKLRSNIQLPECLRIVAHLPRIGVSV

SEQ ID NO: 9101 - protein, 231 aa, Zea mays
HASGTAVENFQVILGSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQAFIEVAYPYCAACFGRCYPDGATLISECQGTFDAVRQLLTVPARSNSSSIERRQSGGIERRQSGAIERKQSVESTGTAVTDNGLSADGPGLETNSSAATTTSPVDDGGSTHPPASK

SEQ ID NO: 9102 - protein, 374 aa, Zea mays
MALIMQESSSHDLLQAHDELLHHSLCFAKSLALAVALDLRIPDAIHHGAGGATLLQILAETALHPSKLRALRRLMRVLTVTGIFSVEQPPAGGGDNSTVHTSDDEAVVVYRLTAASRFLVSDEVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAAAIAAAFPHLKCSVLDLPHVVAGAPSDGNVHFVAGNMFESIPPATAVFLKKTLHDWGDDECVKILKNCKQAISPRDAGGKVIILDVVVGYKQSNIKHQETQVMFDLYMMAVNGVERDEQEWKKIFIEAGFKDYKILPVIGDVSVIIEVYP

SEQ ID NO: 9103 - protein, 455 aa, Desulfovibrio desulfuricans G20
MSAVCFFVQRHLCALRVYRQPAAWKILPSHASETMKTGFFNVLDVQSFIDRLRGFDHLPALQTPLDEAHGCVLAAPVVSPEDLPAADRSCMDGYAVRAADLFGTTEGNPAYLECTGTVSIERPADFSIAAGECAAIVTGALLPRGADAVVMVEHTQEMGAGTVEIRKSVAPHEHVMLRGEDAVQGQPALTAGTLLRAQEIGLLAALGVQTVHVHRRPRVGIFSTGDEVIPAHATPRPGQVRDVNSHALQAMARAAGAAVTCYGIVPDDEKALTAMLARTTAENDMVLLSGGSSVGTRDLTMAALDSLDGAAVINHGVAISPGKPLILASADGKGQRCAVWGLPGQVTSAQVVMFVLGIPFVHWLAGRRTPFDQSAWASRRAVLARNIASRQGREDYIRVRLHAEEDGRVTATPVTGKSGLLRTMLQAHGVVRIPAHSEGLDSGTQVDVLLFGGGY

SEQ ID NO: 9104 - protein, 562 aa, Oryza sativa
ARGPPAAPGGVVAGEPAAGVGRGAAAPPPTGEGPSLAGLIARARATQFPDSVGGLAGAEQLPGGFCFSAAAKRGGPAPAPPWVPWRGVAADDISLPRFGGLGVRPAPGGAPALSVRRVWVVSSSHPKSKYPVLQLDLRLISDLVVVIVSATFGGIAFACLGQPVITGYLLAGSIIGPGGFGFVSEMVQVETVAQFGVIFLLFALGLEFSTSKLRVVRAVAVVGGLLQIILFMLLCGISATLCGGKTKEGVFVGVLLSMSSTAVVLKFLMERNSINALHGQVTVGTLILQDCAVGLLFALLPILSGASGLLQGVASMAKSLVVLITFLTILSILSRTGVPWFLKLMISLSSQTNELYQLAAVAFCLLFAWCSDKLGLSLELGSFAAGVMISTTDLAQHTLEQIEPIRNFFAALFLASIGMLINVHFLWNHVDILLAAVILVITVKTFIVAVVVKGFGYSNKTSLLVGMSLAQIGEFAFVLLSRASSIHLIEGKLYLLLLGTTALSLVTTPLLFKMIPAVVHLGVLLRWFSVDSNQVELGLKSDGLRIDSGKRINLIVQGSHDS

SEQ ID NO: 9105 - protein, 258 aa, Zea mays
  unsure (1)..(258): unsure at all Xaa locations
MAGAVVAADSKIDLLRDAAALLGEMGEIEKVGFFYLDWRDLSGDVSSIXWNKILTPTDERXACDPLFAPNGHIMXLLRTVMCTFLLMLFSVPTPGMISISAWPFMAXIRSSFGYIYLAWYAVCSEISFSLDVXFLVVSCNTRDEFRMIDCTDCDSTLALFTFHERRYPRVVXTEDVLPLPSMGXMGKDGWDPSDHGDVMPSLNSCGYLHTLLSXGKEYXYQARFYNLGWIGDIQILNPWSPTEKRLDGSPPKNFGPVV

SEQ ID NO: 9106 - protein, 334 aa, Xylella fastidiosa 9a5c
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKFTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 9107 - protein, 198 aa, Streptococcus mitis
GIEDILVVTGKSKRSIEDHFDSNFELEYNLKEKGKHDLLKLVDETTGIRLHFIRQSHPRGLGDAVLQAKAFVGNEPFVVMLGDDLMDITDDHAVPLTKQLMNDYESTHASTIAVMPVPHEEVSAYGVIAPQGEGINGLYSVETFVEKPAPEEAPSDLAIIGRYLLTPEIFEILENQAPGAGNEIQLTDAIDTLNKTQR

SEQ ID NO: 9108 - protein, 247 aa, Saccharomyces cerevisiae
  unsure (1)..(247): unsure at all Xaa locations
ARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 9109 - protein, 602 aa, Oryza sativa
MELALVGNPSNGVAKPSCNSVGSLPVVSSNAVIHPPVTSAARATLGRHLARRLVQIGATDVFAVPGDFNLTLLDYLIAEPGLKLIACCNELNAGYAADGYARALVGAFVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 9110 - protein, 293 aa, Zea mays
  unsure (1)..(293): unsure at all Xaa locations
HQLSFFLLPPQLLRPLDLIAHHPRKRLDRRRSRPWXPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTXVGVKCLFXDEAVTVGGTCHTHGHKGLDRF

SEQ ID NO: 9111 - protein, 276 aa, Archaeoglobus fulgidus DSM 4304
MKKWIVLALTVTFWGLAFTAIKYSVRFLSPIAIASLRFAIANTLFAVIIILGKRIKWKDLPKVFALGIFGVSVYHVFLNLGEVYISSGVASVVISLAPIFVLILSAIFLRERITYSKVVGIIIAFLGVVVISEPSYANIYGIALVMVSTVAAAIYTTFGKSLLSKYNPITLTSNAMVLGSIPLYPFLPDSIRSLGGDLNLIGSIVFLGIFSTFFGYLGWYYFLEKEEASRASVFLLAIPVVSLLAGNILLAEPLTLRTVAGSGLVLLGIYIVVRKR

SEQ ID NO: 9112 - protein, 530 aa, Clostridium pasteurianum
NSVYRLKEIVKVLAYYGFGFIVDSKLNGNKKSPENLRKAFEELGPTFIKIGQILSTRPDLLPLPYIKELSKLQNNVPPENFIDIENLFFEELSSTIDNTFLYFDKTPIGSASIAQVHDAILKDGRFVIVKIQRPGIAEMMKTDLSIIKKLLNITKTKFTDALIDPKEAIDELFISTTQELDFINEINNIKKFKKLNEDVKFVRTPYTIDKLCTEKIIVMEKIVGIKIDNLKKLLNEGYDLEELGKKLTLSYFKQVFQDGFFHGDPHPGNLLIRENHICYIDFGIMGTISKSLKISLNDAILAVAYHDVNKMISVIMSIGVKKGYVNRNSLYESIEYLFDNYISVSLKNIKISVMLQEIFQISKNNNIKLPKELTMLLKSTLMIEGVIARISPELSIVDVLIPYVKSQNQNLFFRNFDFDNLLLNGFKFVKSSSEFPSKFVELSESIIRGRAKIQLQHNNLQKPIKDLNRMVNRMVFAIIISSMIIGSSLILRTNIGPKLHDISIIGISGFMIAALMGFYLLISILRSGTL

SEQ ID NO: 9113 - protein, 367 aa, ASPERGILLUS NIDULANS FGSC A4
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQAIASAYPGLFIQKHVHVTGSAVGNRNEAIETMEFAARGVIKAHFREEKMEALTEIFKEMEEGKLQGRVVLDLS

SEQ ID NO: 9114 - protein, 427 aa, Batrachospermum theaquum
IEASAAIAGESSTATWTVVWTDLLTACDLYRAKAYKVDAVPNTSDQYFAYISYDIDLFEEGSISNLTASIIGNVFGFKAVKALRLEDMRLPIAYLKTFQGPATGTIVERERMDKFGRPFLGATVKPKLGLSGKNYGRVVFEGLKGGLDFLKDDENINSQPFMRWRERYLFSIEGVNRAQASAGEIKGHYLNVTAATMEDMYERAAFAKELGSIICMIDLVIGYTAIQSMAIWARKSDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 9115 - protein, 811 aa, Oryza sativa (japonica cultivar-group)
MPSYQYLLSLLFYILDCTDRFSVIVTIHNHRVGVLMIVLLQDQWKSYCRTISLLAFQSFGVVYGDLSTSPLYVYKSAFSGRLNNYRDETTIFGLFSLIFWTLTLLPLLKYVIIVLNADDNGEGGTFALYSLLCRHAKFSLLPNQQSADEELSTYYQPGVGGIISSPLKRFLEKHRKLRTCLLLFVLFGACMVIGDGVFTPAISVLSAISGLKDPGPGGIPDGWVVFIACIVLVGLFALQHRGTHRVAFMFAPIVVVWLLSIGVIGLYNIIHWNHRIFLALSPHYVIKFFKMTGKDGWLSLGGVLLAITGTEAMFADLGHFTAASIRLAFVGAIYPCLVLQYMGQAAFLSRNMSAVEDSFYQSVPRSLFWPVFVIATLAAVVGSQSIISATFSIVKQCLSLGCFPRVKVVHTSRWIHGQIYIPEINWILMVLCLAVTLGFRDTTVIGNAYGLACIVVMFVTTWLMALVIIFVWQKNILLALLFVVAFGSIEVVYLSAAVTKVPQGGWAPIVFAFVFMLVMYVWHYGSRRKYLFDLQNKVSMKWILTLGPSLGIVRVPGIGLIYTELVTGVPSIFSHFVTNLPAFHQVLVFVCVKSVPVPFVPEDERYLIGRIGPREYRMYRCIVRYGYKDVQKDDENFENHLVMSIAKFIQMEAEEAASSGSYESSEGRMAVIHTEDTTGTGLVMRDSNNEASGTSLTRSSRSETLRSLQSIYEQESGSLSRRRRVRFEIAEEERIDPQVRDELADLLDAKEAGVTYIIGHSYVKARKNSNFLKTFAIDYAYSFLRKNCRGPAVALHIPHISLVEVGMIYYV

SEQ ID NO: 9116 - protein, 336 aa, Oryza sativa
MATARVSLILLVVVLAASACAEGLRLPRDAKFPAAQAERLIRSLNLLPKEAGPTGAGDVPSVAPGELLERRVTLPGLPQGVGDLGHHAGYYRLPNTHDARMFYFLFESRGKKEDPVVIWLTGGPGCSSELAVFYENGPFTISNNMSLAWNKFGWDTFHDEFNNGSGHCCSQFTSYNDQAYTPFGSFVSTPSDKTFFMQISNIIFVDQPTGTGFSYSSDDRDTRHDETGVSNDLYSFLQVFFKKHPEFAKNDFFITGESYAGHYIPAFASRVHQGNKANEGIHINLKGFAIGNGLTDPAIQYKAYTDYALDMNLIKKSDYDRINKFIPPCEFAIKLC

SEQ ID NO: 9117 - protein, 474 aa, Ciliophrys infusionum
  unsure (1)..(474): unsure at all Xaa locations
RYESGVIPYAXMGYWDANNIVKVTDVLALFRITPQPGVDPVEAAAAVAGXSSTATWTVVWTDLLTACDVYRAKAYRVDPVPXSSDQFFGYIAYECDLXXRSSIANLTASIIGNXXGFKAVKALRLEDMRIPFAYLKTFQGPATGVVVERERLNNFGRPILGATVKPKLGLSGRNYGRVVYEGLKGGLDFLKDDENINSQPFMRWRERFLYVQEGITRASASTGEVKGSYMNMTASTMEDAYERGEYAKELGTIIVMVDLVMGYTAIQSAAIWARKNDMILHLHRAGNSTYARQKNHGINFRVICKWMRMAGVDHIHAGTVVGKLEGDPLIVKGFYNTLLNVTTEVNLPQGLFFAQDWASLRKCLPVASGGIHCGQMHLLLNYLGDDVVLQFGGGTIGHPDGIQAGATANRVALEAMVLARNEGRDYVAEGPEILQEAAKMCGPLQTALDLWKGISXNYSSTDTADFAETPTANV

SEQ ID NO: 9118 - protein, 332 aa, Helicobacter pylori 26695
MKIFINGFGRIGRCVLRAILERNDTNPKLEVIGINDPANWEILAYLLEHDSVHGLLPKEVRYSNYKLIIGSLEIPVFNSIKDLKGVDVIIECSGKFLEPKTLENYLLLGAKKVLLSAPFMGEYDEKQYPTLVYGVNHFCYQNQAIVSNASCTTNAIAPICAILDKAFKIKEGMLTTIHSYTSDQKLIDLAHPLDKRRSRAAASNIIPTTTKAALALHKVLPNLKNKMHGHSVRVPSLDVSMIDLSLFLEKKAPKDPINDLLIEASKGVLKGVLEIDLKERVSSDFISNPHSVIIAPDLTFTLENMVKIMGWYDNEWGYSNRLVDMAQFMYHY

SEQ ID NO: 9119 - protein, 415 aa, Oryza sativa
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMKLVSWYDNEWGYSNRVLDLIGHMALVNAKP

SEQ ID NO: 9120 - protein, 273 aa, Pisum sativum
MDMEGSIGTKEHLAKGKRTKRGIRMLSPCTVANTTVTSSCSSAIGDGGRSFSSTTFDSTEQEEEADMANCLILLAQGRTGGQEETRCHNHRQQDGGYNNIVTEKATRNGFESYECKTCNRFFHSFQALGGHRASHKKPKMKEIISAGETEEQNNHIHNKNVSTISPLVPPHVSLELRCGGNLNFHGHGNNNKPNRSNKVHECSICGAEFTSGQALGGHMRRHRACTNKNNNNNVGDVHGKTRNILELDLNLPAPEEDLRDSTFQFPAMVGCHY

SEQ ID NO: 9121 - protein, 573 aa, Saccharomyces castellii
MSERKMENLTGTMHQLNFNLPNQPNRGSTSQFASLDNFSTPTKYKNDKLNGSPIPPGARRYEIDDSDSKMDIDGSSYNDIDITNSPKKLPQGFQTMASNNKTQRLVSVCKMYFLDYYCDMFDYVISRRQRTKKVLEYLEQKKNENVDLNSLNNEWNGYIQREHQVLRKRRLKPKHKDFEMITQVGQGGYGQVYLPGKKDTNEVCALKILNKKLLFKLNETNHVLTERDILTTTRSQWLVKLLYAFQDTQNLYLAMEFVPGGDFRTLLINTRFLKSTHARFYISEMFLAVNALHDLGYTHRDLKPENFLIDAKGHIKLTDFGLAAGTISNDRIQSMKVRLEEVKNLEFPEFSDKSIEDRRQMYQKYRETEVNYANSMVGSPDYMALEVLEGKKYDFTVDYWSLSCMLFESLVGYTPFSGSSTNETYENLRHWKKTLRRPMLDNGRPAFSDRTWDFITRLIADPINRLRSFEHVKRMTYFESVDFNTLRDLSPPFIPQLDNETDAGYFDDFTNEADMAKYADVFKRQNKLSTMVNDADIDSKLVGFTFRHRYGKNGSSGVLYNGLEQSDPFSTFY

SEQ ID NO: 9122 - protein, 334 aa, Pseudomonas aeruginosa PAO1
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHEVLRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASEGSPVLGYNTQPLVSVDFNHDPRSSIFDANHTKVSGRLVKAMAWYDNEWGFSNRMLDSALALAAARD

SEQ ID NO: 9123 - protein, 251 aa, Cytophaga hutchinsonii
MRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAKSY

SEQ ID NO: 9124 - protein, 544 aa, Actinobacillus pleuropneumoniae serovar 1 str. 4074
MTCKNTRRLYQIITTFLRYGIDEIIPDIPLTRHARLGRKALFWVRNQHKDQPFGVRLRLALQELGPVWIKLGQMLSTRRDLFEPELAEQLALLQDSVEPFDGKSARQIIEQALGGSLETWFDEFDEQALASASIAQVHTAKFNQNQPLAGKDVVLKVIRPDIEPIIKADIALMYRLASWIPRLSNDAKRLRATEVVREYEKTLLDELDLTREMANAIRLRNNFENSEMLYVPEMYQDFCHKNVIVMERIYGIPVSDVETLKANGTDMKLLAERGVQVFFTQVFRDSFFHADMHAGNIFVNPNHPENPQYIGIDCGIVGTLNQNDKRYLAESFVAFFNRDYRRVALMHVESGWTPPDTDIDAFEQAFREVCEPIFAKPLSEISFGHVLLNLFNVAREFNMEVQPQLVLLQKTLLYIEGLGRQVYPQLDLWQTAKPFLQNWLNEQVGVKAILRDLKQRAPQFREHFAEFPEAVFNALQQQKQINFRLDELNKTLQAQGRQKSHNVRSIVSGVIILGVLWRFDDLPLWLSCGTLVTVLLVLLLQRKS

SEQ ID NO: 9125 - protein, 351 aa, Zea mays; identical to SEQ ID NO: 4955

SEQ ID NO: 9126 - protein, 186 aa, Zea mays
RSPWHQIGNTWPLPQPRSGHSLTWIGSTCMVLFGGRGSEFEVLNDVWLFDISDQYPKWKELKYGLSSALGELPFPRVGHSAILVLGGKVLVYGGEDSQRRRKDDFWILDTPALLQYESGSKKMTRKMWKKLRIDGQCPNYRSFHGACVDASGCCVYIFGGMVDGLVHPSEALGMRFDGHLYQVELV

SEQ ID NO: 9127 - protein, 312 aa, Klebsormidium flaccidum
GINGFGRIGRLVMRAALERSDVEVVAVNDPFIDADYAIYMFTYDSVHGEVQREDREEDAHTISFDGHDVAFYAARDPSEIPWGKHGADYVVESTGVFTDMDKAAAHLKGGAKKVIISAPSKDAPMYVMGVNHEKYKTSDDVISNASCTTNCLAPLAMVVNNKFGILEGLMTTVHATTATQKTVDGPSNKDWRGGRGASTNIIPSSTGAAKAVGKVLPELNGKLTGMAFRVSTADVSVVDLTVRLEKPAKYDDIVAAIKEAADGPLKGILGYTSDDVVSQDFVHDSRSSIFDIKAGIALNDSFVKLVSWYDNE

SEQ ID NO: 9128 - protein, 282 aa, Oryza sativa
  unsure (1)..(282): unsure at all Xaa locations
PRVFPTRGGRTSPLALALAALLLASALLLALIAFGVFSLPVSAPNAATTDXRRRRGRRRSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHGGCPVIKGNKWSSTKWMHVREYKA

SEQ ID NO: 9129 - protein, 371 aa, Colletotrichum gloeosporioides f. sp. malvae
MAQNRPSAFNTLRMGGKLGVKPLTRRGCSANASIREKVQDGITGETRDLQYTQCKIVGNGSFGVVFQTKLSPSGEDAAIKRVLQDKRFKNRELQIMRIVRHPNIVQLKAFYYSNGERKDEVYLNLVQEFVPETVVPRVAVFNKMKTTMPILEVKLYIYQLLRALAYIHSQGIWHRDIKPQNLLLDPTSGVLKLCDFGSAQDLKKTNPNVSYILLANSNSISKLIRIPSNLHAADVWSTGCVMAELMLGQPLFPGESGIDQLVEIIKVLGTPTREQIRTMNPNYMEHKFPQIKPHPFAKVFRKADANAIDLIARLLESTPTERQAAVEAMVHPFFDELRDPSTRLPDSRHQSGEIRDLPPLFDFTRHGKLPP

SEQ ID NO: 9130 - protein, 135 aa, Haemophilus influenzae
EDPTPTLEGADVVLISAGVARKPGMDRSDLFNINAGIVRGLIEKVAITCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 9131 - protein, 753 aa, Escherichia coli CFT073
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDTNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQVAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQHHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIANNGDANYYLMEAYKHLKPIALAGDARKFKATIKVADQGEEGIAEADSADGSFMDELLTLMTAHRVWSRIPKIDKIPA

SEQ ID NO: 9132 - protein, 178 aa, Glycine max; identical to SEQ ID NO: 6669

SEQ ID NO: 9133 - protein, 458 aa, Bacillus cereus ATCC 14579
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 9134 - protein, 463 aa, Lactobacillus gasseri
MVLMENKKNHPPKLKRSMTAGQMEMISLGGAIGVGLFMGSTSTIKWTGPSVLLAYMFVELILYIVMRALGEMLYVSPGTGSFADYATEYISPLAGYLAEWANVFQYIVVGISEVVAATEYLKFWWPQVNVFWSGIIIIALLLLANLASAKAYGALEFWFAMIKVVTIILMIILGLFVILLGVGNHGKPLGFSNLWSHSGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLSHEGEAPKIFGKLSKHIVPDRAIIGITVGILVGFVLNLIVSTMNKSMGELFVIVYSSSVLPGMVAWFVILIAELKFRKSNTHLMDKHPFKLPLYPYSNYFAFMMLLIIVIFMFINPETRVSVTVGAGVLVLAAIVYAIKHRKKK

SEQ ID NO: 9135 - protein, 365 aa, Pseudomonas aeruginosa UCBPP-PA14
MVHNRIDPPFTRYLDSDGRPLGELPAWAGDSDALVGLYRQMLLTRLFDQKAVALQRTGRIGTYAPTLGQEAIGVAIGSQMRAEDVLVPYYRDTAVQLMRGVRMEDILLYWGGDERGSDYAEPLAAQDFPICVPIATQALHACGVASAFRIRGEHRVAVTTCGDGATSKGDFLEALNVAGAWQLPVLFVVNNNQWAISVPRRIQCGAPTLAEKAVGAGFPGEQVDGNDVLAVAERVRAALERARQGKGPTLLECISYRLCDHTTADDASRYRSAEEVNQAWREEPIKRLRAFLAGRGQWDEEREQALVGECQARVQEAVERFETFAAQAPQALFEHVYARWPAALEEQREQLLERAARRQGGAEHE

SEQ ID NO: 9136 - protein, 741 aa, Oryza sativa
MSSSSCAAGAEATGLVAMDCLVVCCCCPCLVLQITVFLFVRLPKKGLSSVKKQLEELFDDDDLFQGAFGGGINGGGGDDEEGWWKERCFAVDDDDGGVWEALIEQEGLFWFGSFWGRTTEQVDRPDQFGDDEHAHPALSVRARIQSPHRSLPLLPAAAAETKRGPSGASFIREHLRSLAPYQPILPFEVAKALGNLKFPYVYPDPESRQLRAALAEDSGLESEYILAGCGADELIDLIMRCVLEPGDKIVDCPPTFTMYEFDASVNGALVIKGLAGLRVGYGAFPLSIIEYLWRAKQPYNVSVAAEVSACAALQNPTYLEEDLAKMGVMIRHYDKKELKGYIRISVGKPEHTDALMKGLKALQLFVEKPPWKSPPNLRKSFATVPPWNCKPAIVVQQMHNLSTSSPGKIPYYKRVPPFFSMPIPRLPLLLKIAAATAAGALALIVAAGLRRDDAVASLRREIRDAVAALVASNEDGVVEGEGEGEDAAEAPAPSVLITGFRAHGKSSLVNTACRALAAEEGPLLLRAEASPPGGGSDGTRKRRRVKAAVAGDSGDAGTDEAVVELLDAPPLPEATRATRADIDAAISGGNPECVVLALRCDAPAKERNAAVKRLPEISAAVRAKGLNLIVVLTFKKAMRSARQAEELIREVSFRARTDCVYFIENYTWNNNGPNLRHPPVIKNDFETHFTVLTIIRQCLEFIKLNRSQSKREENGEKGNSGDVKGELSVKPADVKPVLTVQ

SEQ ID NO: 9137 - protein, 290 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPAEDHVVVINVGKADKSSCAEVRPVTEMAGAVDVPRRCAAEAAAAPGVDFARSVNVV

SEQ ID NO: 9138 - protein, 611 aa, Neurospora crassa
MSHSQNPQDEQAQKGSKFSHLPLSTSGPLECALKGTVLLNHPYFNKGSAFTKEERRDFALHGLLPPQIQSLEQQVQRAYEQYCSQPNDLAKNTFMTSMKEQNEVLFYRLLHDHLDEMFSVVYTPTEGEAIQNYSRLFRRPEGVFLNINDMDSVKRDLAQWGKPEDIDYIVVTDGEEILGIGDQGCGGILISIAKLVLMTICGGIHPNRVLPVVLDCGTNNEELLKDDLYLGLRQKRARGDKYDDFVETFIKAARELYPRAYIHFEDFGLDNARRLLERYRPQMPCFNDDVQGTGCVTLAAIMAGLHISKQKLSDVRMVVFGAGTAGVGIADHVRDAIAADADISPEEAGKQIWLIDKPGLLTTKSESLSDAQKKYAKSHDDWANEKTDLLAVIKEVKPHILVGTSTKPKSFTEEVVREMAKHVERPIILPLSNPTKLHEAVPEDLLNWTDGKALVATGSPFDPVKGPWGKDGKEIEIDVAECNNSVVFPGIGLGSVLSRANRVTDKMLMAASKGVAEMGPALRDDTAPLLPGVDVVRDVSVRVARRVILAAMEEGVVEEKDVPTNEEDLDEWIREQMWDPVYRPLKYVEGNKASRGAKGDLRVLGNPNDVE

SEQ ID NO: 9139 - protein, 257 aa, Silene latifolia
MGRGRVQLKRIENKINRQVTFSKRRTGLLKKAHEISVLCDADVGLIVFSTKGKLFEYATDSCMEKILERYERYSYAERQLTAPDPDSHVSWTLEHAKLKARLEILQKNHRHYMGEDLDTLSLKELQNFEHQLDTALKHIRSKKNQLMYESIHELQKKDKALQEHNNTLSKKVKEKEKEKEKEKAIADQQAQWVQQNQELNPSAFFSSQVLPALNIRGNYETGSSVIVNEVAQTQNRSNSSNNNSLVPSWMLNHLAEQ

SEQ ID NO: 9140 - protein, 172 aa, Synechocystis sp. WH 8501
MDLKALIRDIPDFPKQGIVFRDITTLLSDAEGLRYTIDTLKEKCLSANLSPDYIVGMESRGFLFGAPLAYQLNAGFVPVRKPGKLPAAVHKVEYELEYGTDSLEIHQDALEDHHNVLIVDDLMATGGTAKATAELLEKIGCNVLGFAFIIELKALEGRKKLPDVPIITLIEY

SEQ ID NO: 9141 - protein, 265 aa, Triticum aestivum
MRRVRVSSHHSPVQKLGDSDMKLTPRFRLAGTTSPSSTEPEQQPPWEMPLIPGLPDDAALNCLLRLPVEAHGACRLVCRRWRHLLADKARFFTHRKAMGLRSPWLFTLAFHRCTGKIQWKVLDLDSLAWHAIPGMPCRDRACPRGFGCIAVPGEDGAHLLVCGGLVSDMDCPLHLVLRYDVCKNRWAVVPRMLSARSFFAGGVIDGRVYVAGGYSTDQFELNSAEVLDPVNGVWQPIASMGANMASSDSAVIGGRLYVTESCAWP

SEQ ID NO: 9142 - protein, 466 aa, Pterocladiella capillacea
  unsure (1)..(466): unsure at all Xaa locations
YAKMGYWDPDYTVKETDVLALFRVSPQPGVDPVEASAAVAGESSTATWTVVWTDLLTACDLYRAKAYKVDDVPNTNDQYFAXXAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIASSGEIKGHYMNVTAATMEDMYERAEFAKQLGTVIIMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVIARNEGRDYVAEGPQILRDAXKTCGPLQTALDLWKDISFNYTSTDTADFVETPTANV

SEQ ID NO: 9143 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 9144 - protein, 317 aa, Haemophilus somnus 129PT
MSKTLTVLGSINADHVISVPHFAKPGETLSGKQYHIAYGGKGANQAVAAARLADFSQGATVNFVGCIGSDDIGQAMKKAFAQDGINVATITEIPNEMTGIAMIQVADSGENSIVISAGANAYLTPEIVDKFATEIERADYLLMQLETPLNAILEAAKLAKKHGATVVLNPAPASQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 9145 - protein, 199 aa, Zea mays
  unsure (1)..(199): unsure at all Xaa locations
VDDNDTLDSVEQRCIVNVCQPGSNLLAAXGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 9146 - protein, 1060 aa, Arabidopsis thaliana
MASKSDVNIIETSSKVHFSGFHQMDGLASNRPEQMAEEEEHGQPFVIGESRGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDAGLSHTKPVNTYVVKSVAYMRRCTCICTHEDADVRLARRIKRDTVEKGRDIATVLDQYSKFVKPAFEDFILPTKKYADIIIPRGGDNHVAIDLIVQHIHTKLGQHDLCKIYPNLYVIQSTFQVVEHGLGHLPFTEKQVVTPTGSVYSGVDFCKKLCGVSVIRSGESMENALRACCKGIKIGKILIHREGDNGQQVCVLSLLITSPNYLLTTNGTHQLIYEKLPSDISERHVLLLDPILGTGNSAVQAIRLLISKGVPESNIIFLNLISAPEGVNVVCKKFPRIKIVTSEIELGLNDEFRVVPGMGEVSIPYHLRKTLQKIREYTGKQHSDEDIFAVYKDSFNDPHETAQKLLFLDTFHEVRSKREKKKEASPIVPVTQPSGRGGRRNFASSNSYQGSGRNASFKRENGANHVTRGSRTAQPATNKASNITVPNETKVSGPASIPSEVSNHKAQDDPSLISASRCSSKSDQAIEIETASKQGKNQSLPKPDVSEQSHVTFPFHLQVAKGLQNGLTFGSFDSNFVKEVSSSNGASGGYDSNFESSHGTGDDERESSPTTNGITGVASARFVTEILSLYILEETSTVSEDKDYGISNSATGAEPVVHSDHIVPPVEEVPKEEALSNTETHQIAYGQEAPLSVFGLVPSLSAIGQPVNTEAAETQPGNSNSPPISLVSYPPDQSSIAAATQQTNFLRQQYPPNFFPYGYYSPYYMPPPYIHQFLSPNGIPQQSYFPQGAALTAPSHAKPVDNTENPPTTNPYLHTSPMVASSIPSTTTLNSIHSEEKASHLTESAAAWIGQGFGNLQVNPMYNLAYQGQPLGFPVVQAGHGGLMGMHQPTQPMAAASTTYQTLPPPPHTTTAMGEPIGHPHIAYQQPQAALTNWVNNY

SEQ ID NO: 9147 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 9148 - protein, 521 aa, Hordeum vulgare subsp. vulgare
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAGQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGNHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDGIDA

SEQ ID NO: 9149 - protein, 358 aa, Oryza sativa (japonica cultivar-group)
MAGGRGARASLHLHLAWLCAFATTAWAHGGGGGGGDSDADADGGGEGKPDLRARGLVAAKLWCLAVVFAGTLAGGVSPYFMRWNDAFLALGTQFAGGVFLGTAMMHFLADANETFADLLPGTAYPFAFMLACAGYVLTMLADCAISFVVARGGGRTEPAAAAGAGLEEGKLSSTNGNASDPPAADAAAQDHSVASMLRNASTLGDSVLLIAALCFHSVFEGIAIGVAETKADAWKALWTISLHKIFAAIAMGIALLRMLPDRPFLSCFGYAFAFAVSSPVGVGIGIVIDATTQGRVADWIFAVSMGLATGIFIYVSINHLLSKGYTPLRPVAADTPAGRLLAVVLGVAVIAVVMIWDT

SEQ ID NO: 9150 - protein, 178 aa, Glycine max
MPSLFSKHLHLCFFKPKYPTILCQHSHHTPPPSSADNSDATSSTSTEPDFASIFASQRFFFSSPGTSNSIVESPDTRTFVVPTGGGVGVPKYSLNPYVDFLRSMQEMIRSRQVLDITKDSEYLHELLLCYLALNPTHTHKFILRAFTDLVLQLLSSAPCLTHNHNHHRRHRSLSGRLL

SEQ ID NO: 9151 - protein, 427 aa, Batrachospermum ambiguum
IEAAAAVAGESSTATWTVVWTDLLTACDLYRAKAYKVDAVPNASDQYFTYIAYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAATGEIKGHYLNVTAATMEDMYERAEFAKELGSIICMIDLVIGYTAIQTMAVWARKTDMILHLHRAGNSTYSRQKIHGMNFRVICKWMRMAGVDHIHAGTVVGKLEGDPLMIKGFYNTLLLSHLDINLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKDISFNYTSTDTADFV

SEQ ID NO: 9152 - protein, 225 aa, Agrobacterium tumefaciens str. C58
MSLPIRIAPSILAANFAKLGQEVADVTEAGADWIHLDVMDGHFVPNISFGPDVIKALRPHSMAFFDCHLMIEPVDPYLEAFAKAGCDSITVHAEAGPHLHRSLQTIRGLGRKAGVTLNPATPLSVIENVLDDVDLILIMSVNPGFGGQKFIPAMLDKIRAAKAMIGDRPIDLEVDGGVTAETAGAIIAAGANALVAGSAVFKGDGVADYRKTVAQLRMAAEAGRT

SEQ ID NO: 9153 - protein, 167 aa, Oryza sativa
AAAPAPCARGSGQASAEEEEEERSSIGADSEDEQDDGEEEVESKASSAAVAAETCRRKTKTKCGGGGGGALACLDALDDALPIKRGLSNFFSGKSRSFANLQDVAAAGATTASLAKPENPFNKRRRILRCSSIRRVSSTSLTALPPFLPPHHHPPPPDDGGGGGGNG

SEQ ID NO: 9154 - protein, 208 aa, Glycine max
  unsure (1)..(208): unsure at all Xaa locations
MNRDRDYELENGLALFGSDEELATQIPTQAQSLVEGSGSIRVAEFKPVPDVDYLQELLAIQQQGPRAIGFFGTRNMGFMHQELIEILSYAMVITKNXNIPFGASGTNAXCIRGALRAEKPELLTVIFPHSLRNQPPESQELLSKVKNVIEKPHNDHLPLIEASRPCNMDIISHVQQVICFAFHDSRLLMEPCQEAKNLRKIVTLFYLD

SEQ ID NO: 9155 - protein, 213 aa, Brassica rapa subsp. pekinensis
MVRGKTQMKRIENATSRQVTFSKRRNGLLKKASELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKEQIEQLKQKEKALAAENKKLTEKWGSHEIEVWSNKNQESGKGDEESSPSSEVETELFIGLPCSSRK

SEQ ID NO: 9156 - protein, 250 aa, Crocus sativus
MGRGRVQLKRIENTINRQVTFSKRRAGLLKKANEISVLCDAEVALIIFSTKGKLSEYSTDARMESILERYDRYSSAERAIVAPDPDSQESWRDEYGRLKAKLEALQTSQRHLMGAQLDMLSVKELQQLEQQLENALKNIRTRKNQLMFDSISELQKKEKTLVSQNKDLEKKLIEKEKGKAMAQQGHWDQQGQQYTESSSPPSLLIQDPFPSLTIGINPASGSSEEDYEARPLPPANSNRLPPWMIRSANE

SEQ ID NO: 9157 - protein, 215 aa, Glycine max
PNTALDREFVFRKTFAGEFPNATMVYFQLVFAAITLILIAGALLGRMNFYAWMLFVPLWVTFSYTICAFSIWSTDGWLFKMGLIDYSGGFVIHLSSGVAGFVAACWVGPRAVKDRERFPPNNILLMLAGAGLLWMGWSGFNGGDPYAASIDASLAVLNTHVCTAMSLLTWLFLDILFFGKPSVIGATQGMITGLVCITPCCRVVQGWAAIIMGND

SEQ ID NO: 9158 - protein, 336 aa, Rhizomucor miehei
MTVKAGINGFGRIGRIVLRASLLNPEVEVVAINDPFIDLEYMVYMFKYDSTHGRFKGTVEAKDGKLVVNGKPISVYAERDPCCIPGRIGAEYIVESTGVFTTKEKAGAHLTGGAKKVIISAPSADAPMFVVGVNLESYSSDMQVISNASCTTNCLAPLAKVIDDEFGIVEGLMTTVHATTATQKTVDGPSGKDWRAGRGAGANIIPASTGAAKAVGKVIPHLNGKLTGMAFRVPNPDVSVVDLTVRLEKSASYEDIKAAIKKASEGSLKGILGYTEDEVVSTDFIGDSHSSIFDAKAGISLNPNFVKLISWYDNEYGYSTRVVDLLVHIAKVDGRL

SEQ ID NO: 9159 - protein, 392 aa, Pseudomonas fluorescens PfO-1
MRPINPACRRIRHDTRRNRHGRTTGRRPECAASPVTAFARFHMYTAIGYAAQTATTPLAPMKFERRSPRADDVAIEILYCGVCHSDIHQARNEWGIAVYPLMPGHEIVGKVTAVGANVTKHKVGDLVGVGCMVDSCRTCEACQSNLEQYCLEGPTMTYATPDRVDGSNTMGGYSDSIVVSEHFVVRIPEKLDLAAAAPILCAGITTYSPLKHYGVKAGDKVGILGMGGLGHMGIKFAKAMGAEVTLFTRSASKAEEGRRQGADHVIVSTDEEQMKAAAGRFDFLLDTIPVQHDLNPYLDTLRFDGVHILVGLIEPIDPPVHAAKLVLGRRVLAGSLIGGVAETQEVLDFCAEHNISCDIEMLDIRQINEAYARMIAGDVKYRFVIDMATLKL

SEQ ID NO: 9160 - protein, 435 aa, Streptococcus agalactiae 2603V/R
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 9161 - protein, 130 aa, Zea mays; identical to SEQ ID NO: 2189

SEQ ID NO: 9162 - protein, 329 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLPSDAVEKFLEGEEVKCRYGQEQQ

SEQ ID NO: 9163 - protein, 200 aa, Glycine max
MAEQALEGSQPVDLTKHPSGIVPTLQNIVSTVNLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 9164 - protein, 427 aa, Batrachospermum pseudogelatinosum
IEASAAVAGESSTATWTVVWTDLLTACDLYRAKAYKVDAVPNTSDQYFAYISYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFAIEGVNRAQAAAGEIKGHYLNVTAGTMEDIYERAAFAKELGSVICMVDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILKDAAKTCGPLQTALDLWKDISFNYTSTDTADFV

SEQ ID NO: 9165 - protein, 507 aa, Fragaria x ananassa
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 9166 - protein, 490 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDALYVPPIREGQGDASQYDRYPEETEQYGQQGEDVHGHLFPDF

SEQ ID NO: 9167 - protein, 230 aa, Staphylococcus epidermidis ATCC 12228
MAKVKEKVAVVTGASSGIGEAIAKKLSQQGASIVLVGRNEQRLNEIAQQLNTPAKVVSADVTVKSNIDDMLKAVIDHFGHIDIVVNSAGQSLSSKITDYNVEQWDTMIDVNIKGTLHVLQATLPYLLKQSSGHIINLASVSGFEPTKTNAVYGATKAAIHAITQSLEKELARTGVKVTSISPGMVDTPMTEGTDFGERKKLEAQNIADAVVYALTQPSHVNVNEVTIRPV

SEQ ID NO: 9168 - protein, 306 aa, Rhodobacter sphaeroides
MILCCGEALIDMLPRETTAGEAAFAPYAGGAVFNTAIALGRLGAPAGFFSGLSTDLFGVQLAETLAASQVETDLCARSDRPTTLAFVRLTNGQASYAFYDENTAGRLLAPADLPALPDRVSTLFFGGISLVNEPAAATYEALMAREAPRRVTMLDPNIRPGFIADAAAYRARIGRMIALADILKLSDEDLHWLEGPGQILSLARGLLARGPKLVLVTEGAVGARAVTATEDRFCAATPVQVADTVGAGDTFNAGVLAALHEAGALSRSAVASLSPETLAAALALGTRAAAVTVSRPGANPPWVDEL

SEQ ID NO: 9169 - protein, 300 aa, Petunia x hybrida
MEKHKSCKLCFRKFANGRALGGHMRSHMMNLYVQKQQMTDEMEYSIPSSSWSSGEVAAGDADDSGIVLPDKESETESSRNQAPFRKSKRSRKSRIVKVKEYSSLVDTEPVSSISENSPEEDVAHCLMMLSRDKWIKQEYDDYSDDDEEEEKSEDSGELVKVTNSTKIKGSRGKYRCETCNKVFRSYQALGGHRASHKKIKVSSSSTNQVENVVEEKIHECPVCFRVFSSGQALGGHKRTHVIGAAASVNVPVFEKPEFSRTGGSLIDLNLPPPMEDDDEIISHVEVSTVSEAELVNPIKY

SEQ ID NO: 9170 - protein, 379 aa, Fagus sylvatica
MAIDCITNITSMPHPPKEEHKDHQKQLVFDASVLRHQTNIPQQFIWPDEEKPRANAPELQVPLIDLRGFLSGDPTAANEASSLVGKACQKHGFFLVVNHGVDDKLIAHAHQYIDYFFELPMSAKQRAQRKVGEHCGYASSFTGRFSFKLPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAVVNSKTPRKSLAFFLCPKNDKVVSPPSELVDSLCPRVYPDFTWPMLLEFTQKHYRADVKTLEVFSNWLQQKNS

SEQ ID NO: 9171 - protein, 256 aa, Pantoea oleae
  unsure (1)..(256): unsure at all Xaa locations
GAAGGIGQALALLLKTQLPAGSELSLYDIAPVTPGVAVDLSHIPTAVSIKGFSGEDATPALQGANVVLIXXGVARXPGMDRSDLFNVNAGIVRNLIQQVADTCPQALIGVITNPVNTTVAIAAEVLKKAGVYDKNKLFGVTTLDIIRANTFVAELKGKNPGELNVPVVGGHSGVTILPXLSQIQGVSFSEQEVSDLTKHIQNAGTEVVEAKAGGGXXTLSMGQAAARFGLSLVRALNGESNVVECAYVEGDGQYAR

SEQ ID NO: 9172 - protein, 285 aa, Glycine max
  unsure (1)..(285): unsure at all Xaa locations
MFGQSMDSARNAAGGVAGTVLIPMRFVWPYGGRSVFLSGSFTRWXELLPMSPVEGCPTVFQVIYNLPPGYHQYKFFVDGEWRHDEHQPYVPGEYGIVNTVLLATDPNYMPVLPPDVASGNSMDVDNDAFRRMVRLTDGTLSEVLPRISDTDVQISRQRISAFLSSHTAYELLPESGKVVALDVDLPVKQAFHILHEQGIFMAPLWDFCKGQFVGVLSALDFILILRELGNHGSNLTEEELETHTISAWKGGKSYLXTEWTGFTQCFIRAGPYDNLKEIAVKILQH

SEQ ID NO: 9173 - protein, 275 aa, Cladonia arbuscula
GAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 9174 - protein, 270 aa, Zea mays
  unsure (1)..(270): unsure at all Xaa locations
ASDWHGGGERRRGGDLLHRPTAILRRDGLRGFYRXGASLGGTVPARALYMAALEATKSSVGSAAVRLGVSEPAASAAASAXAGVSAAVAAQVVWTPVDVISQRLMVQTPDACRYRGGADAFRKILLADGVRGLYRGFGLSILTYAPSNAVWWSTYAVAQRCLWRAVGTERSESCACLMAVQGASAALAGGTAALVTMPLDTVKTRLQVMEADAARPTLASTVRGLLREGGWAACYRGLVPRWGSMSLSAATMVTTYEFLKRLSAKDGSLG

SEQ ID NO: 9175 - protein, 380 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRFAKMSETEVEDQEYNTMLMYYDTGYGIVPSFYGQNKEY

SEQ ID NO: 9176 - protein, 493 aa, Mentha x piperita
MAALLVFFSVSLILLAVLFHKRKSSLSSRKRPPPSPLRLPVIGHFHLIGALSHRSFTSLSKRYGEVMLLHFGSAPVLVASSAAAAREIMKNQDVIFASRPRLSIFDRLMYSGKGVAFAPYGEHWRNARSMCMLQLLSAKRVQSFGGIREEETSAMIEKIRRSKPTTVVNLSEMFMALTNGVIHRAVLGRKGDGGDDFNRILIKVIKLLGSFNVGDYVPWLSWINRINGVDAEVEKVGTKLDGSMEGILRKYRRKKVGDDETNFVDTLLQFQRESKDTDPVEDDVIKALIFDMVSAGTDTTFAALEWTMAELIKNPRTLKTLQNEVREVSRNKGGITEDDVDKMPYLKAVSKEILRLHPPFAILLPRELTQDANMLGYDIPRGTVVLVNNWAISRDPSLWENPEEFRPERFLETSIDYKGLHFEMLPFGSGRRGCPGSTFAMALYELALSKLVNEFDFRLGNGDRAEDLDMTEAPGFVVHKKSPLLVLATPRQS

SEQ ID NO: 9177 - protein, 431 aa, Grateloupia turuturu
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFPVICKWMRMAGVDHIHAGTVVGKLEGDPLMIRGFYNTLLLTHLDMNLPQGIFFEQDWASLRKVTPVASGGIHCGQMHQLLDYLGNDVVLQFGGGTIGHPDGIQAGATANRVALEAIVIARNEGRDYVAEGPQILQDAAKTWAALQQVLDLWER

SEQ ID NO: 9178 - protein, 333 aa, Paracoccus denitrificans
MAVKVAINGFGRIGRNVLRAIIESGRNDIEVVAINDLGPVETNAHLLRYDSVHGRFPAEVKVTDDSIDVGRGPIKVTAIRNPAELPWGDIDVIMECTGIFASKEKVQPHLSTGAKRVLISAPGDNADKTIVYGVNHDTLTKDDIVVSNASCTTNCLSPVAKVLNDSIGIARGFMTTIHSYTGDQPTLDTMHKDLYRARAAALSMIPTSTGAAKAVGLVLPELKGRLDGVAIRVPTPNVSVVDLVFEAARDTSVEEINEAIRTAANGSLKGILGYTDEPLVSSDFNHDSHSSVFHMDQTKVMEGRLCRILTWYDNEWGFSNRMSDTAVAMGKLI

SEQ ID NO: 9179 - protein, 575 aa, Xanthomonas axonopodis pv. citri str. 306
MAKKRTLARFLAETLQSAGVERIWGVTGDSLNGLTDALREMQTIEWMHVRHEEVAAFAAGAEAAVTGQLAVCAGSCGPGNLHLINGLFDCHRSRQPVLAIAAHIPSSEIGLSYFQETHPQELFRECSHFVEMVTNPAQLPEVLHRAMRTAILQQGVTVVVIPGDIALLEVDKHVSSAWPALRQPRVLPAAEDVRQLVELLQQSKAVTLLCGSGCAGAHDAVVALADTLGAPVVHALRGKEYVEWDNPFDVGMTGLIGFSSGYHAMLNCDTLLMLGTDFPYRQFYPKDATIVQVDRDPSALGRRTPLQLGIAADVGETIAALLPQLQRREERGFLEKSLAHYRKAREGLDDLAVPADPGQPLHPQFVTRLISQIADQDAVFTCDVGTPTVWAARYLRMNGKRRLLGSFNHGSMANAMPQALGAQAAFPGRQVISLSGDGGFAMLMGDFISLAQLHLPVKVVVFNNASLGFVAMEMKAAGYLDTGTELRNPDFAAMSNAMGILGIRVDESSQLERALRQAFAHSGPALVDVRVATQELAVPPAIKLEQAKGMGLYLLKAVMSGRGDEVIALVKTNLR

SEQ ID NO: 9180 - protein, 410 aa, Glycine max
  unsure (1)..(410): unsure at all Xaa locations
VLADLIVTQLFYDTDIFLKFVNDCRQIGITCPIVPGIMPINNYKGFIRMTGFCKTKIPADIMAALEPIKDNEEAVKAYGIHLGTEMCKKILAHGINTLHLYTLNMEKSALAILMNLGLIEETKVSRSLPWRRPANVARVKEDVRPIFWANRPKSFISRTIGWDQYPHGRWGDSCNTSYGALSDYQYMRARARHTKLVEKWAVPLXAVDDIWERIRLYCLGKLRSNPWSELDGLQPETKIINELLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEXDASRKLVEEVGGSYFLVSLVDNDYINGDLFTVFADF

SEQ ID NO: 9181 - protein, 340 aa, Prochlorococcus marinus subsp. marinus str. CCMP1375
MTLRVAINGFGRIGRNFMRCWLSRGENTGLDLVGVNVTSDPKTNAHLLKYDSILGQIKDAEIDYTDDTFVINGKTIKCFSDRNPMNLPWREWGIDLVIESTGVFNTFEGASKHLQVGAKKVILTAPGKGEGVGTFVVGVNADQYRHDDFNVLSNASCTTNCLAPIVKVLDQSFGINKGLMTTIHSYTGDQRILDNSHRDLRRARAAAMNIVPTSTGAAKAVALVYPEMKGKLTGIAMRVPTPNVSAVDLVFESGRSITADSINAALKSASEGSMKGIIKYGDTPLVSSDYAGTNDSTIVDTALTMAIGDNLGKVVAWYDNEWGYSQRVVDLAEVVAKNWK

SEQ ID NO: 9182 - protein, 762 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFISEAVRFIEDIQTADGSWYGNWGVCFTYGSWVALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 9183 - protein, 300 aa, Zea mays; identical to SEQ ID NO: 2533

SEQ ID NO: 9184 - protein, 598 aa, Oryza sativa
  unsure (1)..(598): unsure at all Xaa locations
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLXKEKAIIVQPXRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAQAAKDKRVIACIGDGSFQVTAQEVSTMLRWGQKSIIFLINNGGYTIEVEIHXDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 9185 - protein, 98 aa, GIBBERELLA ZEAE PH-1
MSDENANGTPGEQAPANSEHLNIKVTDNNNEVFFKIKRTTKLEKLMGAFCERQGKATSSVRFLFDGTRVQPTDTPDALEMQDGDTLEVHQEQVGGSSL

SEQ ID NO: 9186 - protein, 267 aa, Glycine max
MEGSILERLDFGKMGYGCKHYRRRCRIRAPCCNELYFCRHCHNEATSMLSNPFDRHELIRQDVQHVVCTVCDTEQPVAQVCTNCGVRMGEYFCSICKFFDDDTGKQQFHCDDCGICRIGGRENYFHCNKCGSCYSTSLRDNHMCVENSMRHHCPICYEYLFDSLKDTAVMKCGHTMHSECYLEMLKRDKYCCPICSKSVMDMSRAWKRIDEEIEATVMPDDYRYRKVWILCNDCNDTTEVYFHVLGQKCGHCSSYNTRAIAPPVLPQ

SEQ ID NO: 9187 - protein, 194 aa, Mitthyridium sp. Wall 2559
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTSDVSVVDLTVRLEKPASYDAIKAALKEASQGKMKGILGYTEDDVVSSDFITDSQSSIFDAKAGIALSDTFV

SEQ ID NO: 9188 - protein, 530 aa, Glycine max
  unsure (1)..(530): unsure at all Xaa locations
MVSACVTLKANTHLVKSRKDNTFRQDGGFLGERIKGGLNYSPWIINQLASTSSLRTQEKVNKAKPGVVSAVLTSSNIKESVAFQMPSFLRRKADPKNVVSVILGGGPGIQLFPLTKRAATPAVPVGGCYRLIDIPMSNCINSGLNKIFVLTQFNSASLNRHISRTYFGNGINFGDGCVEVLAATQTQGEAGNNWFQGTADAVRQFTWVFEDAKHTNIENVLILAGDHLYRMNYMXLVQSHVDRNADITVSCAAVGESRASDYGLVKADARGRIIQFSEKPNGADLKAMQVDTSVLGLPLHEAKRSPYIASMGVYVFKTDVLLKLLKWRYPTSNDFGSEIIPAAVRENNVQAYFFIDYWEDIGTIKSFYDANLALTEENPMFKFYDPKTPIYTSPRFLPPTKIDKCRIVDAIISHGCFLRECTVQHSIVGERSRLDYGVELQDTVMMGADYYQTESEIASLLAEGKVPIGIGRNTKIRNCIIDKNAKIGKDVIIMNKDGVQEADRPEDGFYIRSGITVILEKATIEDGTVI

SEQ ID NO: 9189 - protein, 918 aa, Zea mays
MKISALLHFSKKLHGLAQFLLAFALYRLSLPPPTRDCPVLHRHLGFHSVLCPRPGEALSPPPRTPTDRHNPPPLACLVPAMPEIKCGAAEKVKPAASPEAEKPADIAGNISYHAQYSPHFSPFAFGPEQAFYATAESVRDHLIQRWNETYLHFHKTDPKQTYYLSMEYLQGRALTNAVGNLGITGAYAEAVKKFGYELEALAGQEKDAALGNGGLGRLASCFLDSMATLNLPAWGYGLRYRYGLFKQHIAKEGQEEVAEDWLDKFSPWEIPRHDVVFPVRFFGHVEILPDGSRKLVGGEVLKALAYDVPIPGYKTKNAISLRLWEAKATAEDFNLFQFNDGQYESAAQLHARAQQICAVLYPGDATEEGKLLRLKQQFFLCSASLQDMIARFKERKSDRVSGKWSEFPTKVAVQLNDTHPTLAIPELMRLLMDEEGLGWDEAWDITYRTISYTNHTVLPEALEKWSQIVMRKLLPRHMEIIEEIDKRFKELVISKHKEMEGKIDSMKVLDNSNPQKPVVRMANLCVVSSHTVNGVAELHSNILKQELFADYVSIWPTKFQNKTNGITPRRWLRFCNPELSEIVTKWLKSDQWTSNLDLLTGLRKFADDEKLHAEWAAAKLSCKKRLAKHVLDVTGVTIDPTSLFDIQIKRIHEYKRQLLNILGAVYRYKKLKGMSAEEKQKVTPRTVMIGGKAFATYTNAKRIVKLANDVGAVVNNDPEVNKYLKVVFIPNYNVSVAEVLIPGSELSQHISTAGMEASGTSNMKFSLNGCVIIGTLDGANVEIREEVGEDNFFLFGAKADEVAGLRKDRENGLFKPDPRFEEAKQFIRSGAFGIYDYEPLLDSLEGNSGFGRGDYFLVGYDFPSYIDAQDRVDAAYKDKKKWTKMSILNTAGSGKFSSDRTIAQYAKEIWDIKASPVV

SEQ ID NO: 9190 - protein, 158 aa, Brassica rapa subsp. pekinensis
TMGISVKEFPWIKGFNFDVPHVVQVAQVLDGVENVGGDMFDSVPKCDAVLIKWVLHDWGDRDCIRILKNCKEAVPPNIGKVLIVESVIREKKKAMIVEDRDEKLEHVRLMLDMVMMAHTTTGKERTLKEWDFVLNEAGFARYEVRDIDDVQCVIIAYR

SEQ ID NO: 9191 - protein, 75 aa, Populus tomentosa
MEYQNESLESSPLRKLGRGKVEIKRIENTTNRQVTFCKRRSGLLKKAYELSVLCDAEVALIVFSSRGRLYEYSNN

SEQ ID NO: 9192 - protein, 276 aa, Yarrowia lipolytica
MSSERETKTFLARLCEQADRYDEMVNYMKDVAKSGEELTVDERNLLSVAYKNVIGARRASWRVIFPIEQKEEAKGATHHLELLKTYRAKIEAELEDICSDVLDILTNHLLPKAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 9193 - protein, 467 aa, Nitophyllum delicatum
PYAKMGYWDPNYVIKETDVLALFRVSPQPGVDPIEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSIEAVNRSIAATGEVKGHYMNVTAATIEDMYERAEFAKQLGTVIIMIDLVIGYTAIQTMAIWARKNDMILHLHRAGNSTYSRQKIHGMNFRVICKWMRMAGVDHIHAGTVVGKLEGDPKMIKGFYDTLLEPYLDINLPEGIFFQQDWASLRKVTPVASGGIHCGQMHQLLDYLGNDVVLQFGGGTIGHPDGIQAGATANRVALEAMVIARNEGRNYVEEGPKILSDAAKTCGPLQTALDLWKDITFNYTSTDTADFVETPTANV

SEQ ID NO: 9194 - protein, 411 aa, Oryza sativa
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSPTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 9195 - protein, 470 aa, Gelidium caulacantheum
  unsure (1)..(470): unsure at all Xaa locations
GVIPYAKMGYWDPDYXVKETDVLALFRVTPQPGVDPVEASAAVAGESSTATWTVVWTDLLTACDLYRAKAYKVEAVPNASDQYFAYISYDIDLFEEGSIANLTASIIGNVFGFKAVKALRLEDMRIPVAYLKTFQGPATGIIVERERMDKFGRPXLGATVKPKLGLSGKNYGRVVYEGLKGGLDFLKDDENINSQPFMRWKERFLYTMEGVNRSIAASGEIKGHYMNVTAATMEDMYERAEFAKELGTVIIMIDLVIGYSAIQTMAIWARKNDMILHLHRAGNSTYSRQKVHGMNFRVICKWMRMAGVDHIHAGTVVGKLEGDPLMIRGFYNTLLLTHLDVNLPQGIFFEQDWASLRKVTPVASGGIHCGQMHQLLDYLGIDVVLQFGGGTIGHPDGIQAGATANRVRLEAMVIARNEGRDYVAEGPQILRDAAKTCGPLQTALDLWKDISFNYTSTDTADFVETPTANV

SEQ ID NO: 9196 - protein, 305 aa, Dechloromonas sp. RCB
MNSYRRWLPAIALAVLSLTWGYTWVLAKQGLAYAPPFAFAAERCVGGALSLLVALKLTGRRLTLVAPFQTLGIGLTQVAGFMIFQTWALVEGGPGKTAVLIFTMPIWTLLLAWPLLGERVRGKQWLAAASTLTGLLLIIEPWDMHASLFSKFLGLMAALCWASGTILIKRLRAVTPVDLLTLTAWQMILGAVPLVLLALVVPEPATHWTPAYVGLLLFMSVASTAMCWWLWIYILDRVPAWEASLSVLGTPVVAILSSRLTFGESFKGTEIAGILLIGGGLALLSLLGWAASRRNPALTHPKERT

SEQ ID NO: 9197 - protein, 180 aa, Zea mays
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 9198 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLSLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 9199 - protein, 317 aa, Haemophilus somnus 129PT
MTTQLDALRNMTVVVADTGDIDAIKKYQPQDATTNPSLILSASSLPQYAPLIDEAIAYAKAKSADKTQQLIDAEDKLAVNIGLEILKIVPGRISTEVDARLSYDTQATVEKARKLIALYNEAGISNDRILIKIASTWQGIRAAEILEKEGINCNLTLLFSEAQARACAEAGVYLISPFVGRILDWYKANSDKKEYAPAEDPGVISVTKIYNYYKQYGYNTVVMGASFRNVGEITELAGCDRLTIAPALLKELQENSTALVRKLEFKGEVQAKPQPLTESQFYWQHNSDPMAVEKLADGIRKFAIDQEKLEKMLLEKF

SEQ ID NO: 9200 - protein, 492 aa, Manihot esculenta
MDPCKFRPSSSNNTPFWTTDAGAPVWNNNSSMTVGTRGPILLEDYHMIEKLANFTRERIPERVVHARGMSAKGFFEVTHDVSHLTCADFLRAPGVQTPVIVRFSTVIHERGSPETLRDPRGFATKFYTREGNFDIVGNNFPVFFIRDGIKFPDVIHAFKPNPKSHIQEYWRIFDFLSHHPESLSTFAWFFDDVGIPQDYRHMEGFGVHTFTFINKAGKVTYVKFHWKPTCGVKCLMDDEALKIGGANHSHATQDLYDSIAAGNYPEWRLFIQTMDPADEDKFDFDPLDMTKIWPEDIFPLQQIGRLVLNRNIDNWFAENEMLAFDPGHIVPGIHYSNDKLFQLRTFAYADTQRHRLGPNYKMLPVNAPKCAYHNNHYDGFMNFMHRDEEVDYFPSRYDPVRHAERSPIPNAICSGRREKCVIEKENNFKQPGERYRSWAPDRQERFLCRLVNALSEPRITFEIRSIWVSYWSKCDASLGQKLASRLNVRPNI

SEQ ID NO: 9201 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 9202 - protein, 478 aa, Klebsiella pneumoniae
MTAPVQHPMYIDGQFVSGRGDGWIDVLNPATEALLSRIPDGTAEEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVRSGGAGGAGGAGGQPLEGKGYFYPPTLLLDVRQEMDIIHEETFGPVLPVVAFSTLDEALATANDSDYGLTSSIYTRDLNVAMKAIKGLKFGETYINRENFEAMQGFHAGWRKSGIGGADGRHGLNEYLQTQVVYLQA

SEQ ID NO: 9203 - protein, 449 aa, Bifidobacterium longum NCC2705
MSTTTPAQPAQLTRNERLDRLPFNKAHRKLLVASGIGWAFDAMDVGLVSFVVAAIAADPHFNLTPTEKSWVLSIGFVGMAIGAAVGGFIADRVGRKTVFTATLIIFGIANGAMALSWSLGMLLGARLIIGLGLGAELPVASTLVSEFSPTKQRGRMTVLLESFWAVGWIVAAMIGYFVIPNTGDWGWRWALAIGALPLLYAIVTRVHIPESVRFLEAKGREDEAEKAVRYFEEAGGVAPVTSPKGKPLPKIKTRELFGSKYLARTIAIWATWFFVNFSYYGAFTWMPSLLADQFGSLTKSFGYTLAISIAQLPGYFLAAWLVEVWGRRKTLSIFLAVSAVAAFAFSQAGSVALVLVFGMLLSASNLGAWGVLYAVTPEIYPTRLRGAAAGAAAAVGRIAAIIAPLLMPWFLTLSGGNKAVAFIIFAAAFIIACVAALCLPERKGLDLED

SEQ ID NO: 9204 - protein, 213 aa, Streptomyces griseus
MSAATSPSERRVSARIGAISESATLAVDAKAKALKAAGRPVIGFGAGEPDFPTPDYIVDAAVEACRNPKYHRYTPQRAPELKAAIAEKTLRDSGYEVDAGQILVTNGGKQAIYEAFAAILDPGDEVIVPAPYWTTYPESIRLAGGVPVEVVADETTGYRVSVEQLEAARTEKTKVVLFVSPSNPTGAVYSEADAEAIGRWAVEHGLWVMTDEI

SEQ ID NO: 9205 - protein, 379 aa, Oryza sativa (indica cultivar-group)
MTSSSTSPTSPLAAAAHNGVTAAYFNFRGAERVPESHVWKGMHEKDTAPVAAADADGGDAVPVVDMSGGDDAAVAAVARAAEEWGGFLLVGHGVTAEALARVEAQAARLFALPADDKARGARRPGGGNTGYGVPPYLLRYPKQMWAEGYTFPPPAIRDEFRRVWPDAGDDYHRFCSAMEEYDSSMRALGERLLAMFFKALGLAGNDAPGGETERKIRETLTSSTIHLNMFPRCPDPDRVVGLAAHTDSGFFTFILQSPVPGLQLLRHRPDRWVTVPGTPGALIVVVGDLFHVLTNGRFHSVFHRAVVNRERDRISMPYFLGPPADMKVTPLVAAGSPESKAVYQAVTWPEYMAVRDKLFGTNISALSMIRVAKEEDKES

SEQ ID NO: 9206 - protein, 446 aa, Lactobacillus plantarum WCFS1
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 9207 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 9208 - protein, 576 aa, Neurospora crassa
MSDIRTQSLQKPVTVAEYLFRRLHQIGIRSVHGLPGDFNLVALDYVPKAGLKWVGSVNELNAAYAADGYARAKGISALVTTFGVGELSAINGVAGAYSEHVPIVHIVGCPSTISQRNGMLLHHTLGNGDFHVFANMSENISCDVAKLVKPSEIAYQIDHAIRECWIRSRPVYIWLPTDMVEKKIEGARLDTEIDLSEPENDPDREDYVVDVVLRYLHGAKNPVVLVDACAIRHRVTEEVKRFIEKTKLPVFVTPMGKGAFDETSEHYGGVYAGTGSLPEVAKRVEGSDLVLSIGAIKSDFNTAGFSYHTSQLNTIDLHSDHCTVRYSEYPGVAMRGVLRKVTERIDMSKLSITPSPPVENAVAENRDDSQAITQAWFWPRVGEYFQEGDVVVTETGTANFGIWESRFPKDVMGVTQVLWGSIGWSVGAAQGAALAVKDLEQDRRTILFVGDGSFQLTCQEVSTMLKHNLRVTIFLIYNEGYTIERYIHGMDADYNDVTRWNYTDIPAVFGAKEGQSQKFVIKTKDELERLLKDKDFNEYKGLQFVELWMPKDDAPRALKLTAEISARTNSRIEDEQ

SEQ ID NO: 9209 - protein, 379 aa, Zea mays
MAKLGPGQGLGCEAAEGSLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKSFVGHGDSINVIRTQPLKPSLIISASKDESVRLWNVHTGICILIFAGAGGHRNEVLSVDFHPSDIERFASCGMDNTVKIWSMKEFWLYVDKSYSWTDLPSKFPTKYGQFPVLIAAVHSNYVDCTRWLGDFILSKSVVNEIVLWEPKTKEQSPGEGSIDILQKYPVPECDIWFIKFSCDFHFNQLAIGNREGKIYVWKIQSSPPVLIARLYNQQCKSPIRQTAVSFDGSTILGAGEDGTIWRWDEVDHPSSRN

SEQ ID NO: 9210 - protein, 553 aa, Rhodospirillum rubrum
MPTIATALLDALKAHGATRIFGIPGDFALPFFRVAEQSALLPLYTLSHEPGVGFAADACARMGRGLGVAAVTYGAGALNMVNPVAGAWSEKSPLVVISGAPGVAESAGGLLLHHQAKTLDSQWRIFEEITCARTRLDDPLTAPGEIARVLRACLEHSRPVYIEIPRDIVDAPCAAVDRLPPTPVDGEAVEAAAGEIMARLAAASAPALLLGVEVRRHGIEADVAELARRLGLPIATTFMGRGLLSEEGAAGGAPDSLMGTYLGLAGRPEVRAVIEDSDGLLMLGVILSDTNFGVSGKRIDLRRAMLAADRQVALGFHTYNDIPLADLVAALLRQAEGFARQDAKALPKPTALPRDMIADGAPIGPMDIAAAINDLFSAHGVMPIASDMGDCLFTALDTTHAPLVAPGYYATMGFGVPAGLGVQASCGRRPLILVGDGAFQMTGWELGNCARYGWDPIVIVFNNASWEMLRTFQPDTAYNDLADWRFADLAAGLGGVGHRCQTRADLARALDRAAREPGRFHLIEAVLARGAISDTLQRFVTTMKGRHAAAADA

SEQ ID NO: 9211 - protein, 304 aa, Agrobacterium tumefaciens str. C58 (Cereon)
MLAKVLLMILKNEPDMFSSHTIGDRGRMNFLGITGMQYSGVPFTNNRILLAEDSNVFTQMVSMRLNEMLGVSVEVCRSFEELQACYEHSPEPVTLAISNINLPGAEKGEALEYLIDLSIPTIVFTSTFHEATRETLIAKDVVDYILKDNIFAVDMLTESVCRFLTNHRHHVLIVDDSPTARALLSSRLKRYNFRVSLADSGAKALEILRANPDIGLVVTDYNMPDIDGFELTRRIRTVRGSHELRIIGVSSSTNRLLSARFLKAGGNDFMLRPFIDEEFYCRVNQNLDTLVQIQLAKAGIRPAA

SEQ ID NO: 9212 - protein, 99 aa, Glycine max
MSGLIEGLPDADAIRCLAWVPFYLHPKLELVSRAWRAVVRGPELFKARQELGSSEDLMSVCSFEPNNLWQLYDPDRDLWITLMCFPSSIRRVSQKGTPW

SEQ ID NO: 9213 - protein, 340 aa, Hordeum vulgare
  unsure (1)..(340): unsure at all Xaa locations
MAYQYHHHQDHALGMDAAAAAAAGGNPGGGGFAPGLSAGGAWEGEKAAVEAHPLYERLLEAHVACLRVATPVDQLPRIDAQIAARAPPPMPPASALSGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRYNSRLKTPFSXARXXSLSLSLSPGWISFPLHSQKQNKKEQCR

SEQ ID NO: 9214 - protein, 259 aa, Triticum aestivum
MAATLSSVSASSKHCSVVRAQHSSLPSILSTSPAKKTAFRGVSLVDSRWLRRGGARRRLVQVNAKTAGAAKNIEVEVDKPLGLTLGQKSGGGVVITGVESGGNAARAGLKSGDQVLYTSSFFGDELWPADKLGFTKTAIQAKPDSVYFVVSRGGGDIDVKRLPKRPAPPRFGRKLSDSQKARATHICLDCGYIYFLPKAFEEQPDEYGCPQCNAPKKRFARYDVESGKPIGGALPPLTVIVSLVIGIAGIGALLVYGLQ

SEQ ID NO: 9215 - protein, 135 aa, Trichodesmium erythraeum IMS101
ELESTIGELPTKLSDEKAAQSDAEKILMDKETFDQMHAEDRMASQKLDEGIKGFSKALESLEKLLAERLTRLEGVTHAAEDIFYIYDLDGDGFITREEWAGSDAVFDALDINKDGKISPAEMASGLGAVFELAKV

SEQ ID NO: 9216 - protein, 104 aa, Zea mays
PSTGQILAAGTSIQAILISDIITSSDKLPTPSNPYPSRGPSAKSISADVSQIASPQDAEVKVAILTVSDTVSSGAGPDRSGPRAVSVVNSSSEKLGGATVVATA

SEQ ID NO: 9217 - protein, 363 aa, Buchnera aphidicola
MHKQYHIAVLPGDGIGPEVMQEAYKILQVLREHFSLFIKTKEFDIGGIAIDNHGIALPKKTLIGCENSDAILLGSIGGKKWDTLPINERPERASLLPLRKHFNFFCNLRPSNLYKELNFLSPLRNDIVKHGFDILCVRELTGGIYFGKPRGRVTKKKLMYAFDTEIYYKFEIVRIAHLAFKLARSRKHKLCSIDKANVLESSILWREVVEEVSKEYPDVILSHLYIDNVCMQIIKDPNQFDVLLCSNLFGDIISDECAMITGSIGMLPSASLNEKNFGLYEPAGGSAPDIQGKNIANPIAQILSLSMLIRYSMNLNKIANKIDNAVINVLKKGYKTMDISKDQNYLKTNEMGDVIADFLKRDK

SEQ ID NO: 9218 - protein, 175 aa, Triticum aestivum; identical to SEQ ID NO: 5764

SEQ ID NO: 9219 - protein, 597 aa, Stigmatella aurantiaca
MGREFEPAQREGLIVYLRNHQNADGGWGLDVESPSQVFTSVLNYVALRLLGVDAGDAGLRRARQWFLPRGGPLSSGAWGKIILALLGLYEYNGLQPMPPELWLLPESLPFHPSKLWCHCRMVYLPMSWLYGRRARASETPLLAAIRNEIFEGAYDQVDWVAARARVSPTDVYTPRTLWLKVANQAMYGYEWLAGKQLRARALDFALEQIRAEDEATHFICIGPINKVLNMVVWHFVNPEGPEVRAHLERLPDYFFEAADGIKMNGYNSSELWDTSFAVQAAVATGEVERCRPMLAEAARFIEANQVLEDTPEPERFFRHPSKGGWPFSTRDHGWPISDCTAEGLKASLALEPLGLNRVPQARLQDAVQFILSMQNKDGGWATYELQRGPLALEVLNPSDVLSTIMVDVSYVECTSACVQALAAWRKHHQVQDARVDLAISRGAEFIRRAQREDGSWIGSWGVCFTYGTWFGVTGLIAAGVSPGDMVLRRAAAFLRSHQRSDGSWSEVVESCRQGRWIEGTHGHAVNTSWALLTLASVGEQNSEAVRRGIRWLRDRQQEDGRWPPEPIVGIFNRTCAIHYDAYLRIFPVWALAVCDKR

SEQ ID NO: 9220 - protein, 477 aa, Thermoproteus tenax
MILWPMPDVVVVNPATEEVLAVLPSASREEVRRAIDEAEDAFYRWSELPLRERAKLLRRAADLIEADDTLINTLVAESGKPIRDARAELRRAIEIFRASAEEAKYILEGKIPRVDAYDYPLANENRIAMEVREPMGVVAGALSYNNPASTFAHKIAPVIAAGNTVIAKPSSHTPLTALKMAQILQKAGVPQGVVQVVVGSGEEIFNEFVDNPKVVGISFTGSTAVGLQVAAKAAGRGKKFMIAPGGSDPAIVFADADLEAAASIIARARFENAGQNCNATKRVFVERKVYDKFLDILRRKIAAIKVGDPMDESTEMGPVISDKMVKAMEGIVADAVEKGGKLLYGGRRMQRKGYFFEPTLVAFDGRPPEAKAFREEVFGPVLPVAPFEDEREAVELANWTQYGLQSAVFTSDYKRAFRVARAIKAGAVMINDSTRVRFDALPYGGVKMSGLSAGWREGVRSTMLLFTEIKYYVLNIA

SEQ ID NO: 9221 - protein, 480 aa, Zea mays
MGSKSVDEVLDAAAAGVHYSALRLDGQASATTSGLENGHQEPFVIGVAGGASSGKSTVCKMIIDQLRDQRVVVVTQESFYYGLTDEELVHVHNYNFDHPDAFHTELLLSCMQNLKCGKAVDIPNYNFKTYKSVPNARKVNPSDVIILEGILVFHDSRLRDLMNMKIFVDTDADVRLTRRIHRDTIDKGRDLKAVLEQFSKFVKPAFEDFILPTKKYADVIIPRGGDNDVAIDLIVQHIRTKLGQHDLRKIHPNLYVIQTTYQIRGMHTIIRDAATATHDFIFYADRLIRLVVEHGLGHLPFQEKQVITPTGSVYTGVEFSKRLCGISVIRSGESMENALRACCKGIKIGKILIHREGDNGQQLIYQNLPKDIANRHVLLLDPILGTGNSAVQAISLLLKKGVQEANIIFLNLISAPQGVHVVSKRFPRMKIVTSEIESGLNDDFRVVPGMGEFGDRYFGTDEYQSSTPFFCDDKNRVRLL

SEQ ID NO: 9222 - protein, 636 aa, Sorghum bicolor
MISARAATVAAASPASPWKRGGGRSEGAGSCDGCSTYRKTVRRRAAAAKVRALPPKRVEAVAIGSAAETETEEVVVEVAAANEELPVMPWATSVASGYTLLRDPRHNKGLAFTEKERDAHYLRGLLPPAVVSQELQIKKFMNNLRQYQLPIQCYMAMMNLQETDERLFYKLLIENVVELLPYVYTPTVGEACQKYGSIFGRPQGLYVSLKDKGRVLEVLRNWPHRNVQVICVTDGERILGLGDLGCQGMGIPVGKLALYTALGGVDPSACLPITIDVGTNNEKLLNDEFYIGLRQKRARGEEYDELMEEFMAAVKTFYGEKVLIQFEDFANHNAFDLLEKYSKTHLVFNDDIQGTASVVLAGLLAALKMVGGTLAEQTYLFLGAGEAGTGIAELIALEMSKQTKAPIEECRKKVWLVDSKGLIVDSRKSSLAPFKKPWAHEHEPLTTLYDAVQSIKPTVLIGTSGVGRTFTKEIVEAMASINERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAYIAAAVAAKAYELGLATRLPPPKDLVAYAESCMYSPVYRNYQ

SEQ ID NO: 9223 - protein, 426 aa, Chlamydia muridarum
MWWLLVCVVIGGFYTAWNIGANDVANAVGPSVGAGVLTLRQAVLIAAVFEFLGAVVLGDRVIGTIESGLVAPADHVLSSQDYVFGMTAALFATGVWLQIASFFGWPVSTTHAIVGGVLGFGIILKEDAVIYWDSCARIFVSWLASPIIGGYFAFLIFSFIRKAILYKRDPVSAMVRIAPFLSAIIIFALGLILILSGAVARVVAFPVAFRVVCGLVVFAFAFTIWGVHFFKLAVLPQKVGPGTLLDRLLSKSTDYGRQYLVVERIFAYLQIVIACFMSFAHGSNDVANAIAPVAGIYRALYPQSYSPKVLFIFMSLGGLGLVFGLATWGWRVIDTIGKKITELTPSRGFSVGMSSAITIAAASAFGFPISTTHVVVGAVLGVGLARGLQAINLRIIKDIVLSWFVTVPAGAALSIMFFLLLRAVFC

SEQ ID NO: 9224 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGGWEGGDQQNIAYGHPQAHSQGLYQSLECDPTLQIGYSHPVCSEQMAVTVQGQSQQGNGYIPGWML

SEQ ID NO: 9225 - protein, 469 aa, Aquifex aeolicus VF5
MPKYTPEEVLDLIQKEGVQYVDLRFSDPFGQWQHLTIPAYEISKETFEVGRGFDGSSIRGWQSINESDMLAKPDPNTAFIDPFIEPKTLVMICDIYDPVTGERYGRDTRYIAQKAEQYLKQTGIGDTAYFGPEAEFFIFDSVEFGTAANYAFWRVDSEEGWWNREVPSSGYKIPHKRGYFPAPPVDKMMQLRNEMVSIMSDLGIIVELHHHEVATAGQGEIDIRYDSLLNQADKLFLYKYIVRMVAAKHGKYATFMAKVLPNDNGSGMHTHFSIWKNGENLFAGSEYAGLSKTALYAIGGILKHGPAIAAFTNPTVNSYHRLVPGYEAPVRLAYSARNRSAAIRIPMYSQNPKAKRIEVRFPDATSNPYLAFAAILMAAIDGIENEIDPGEPFDKDIYSLPPEELEGIPQLPGSLEEALKALEEDYEFLLKGNVFTEEFIQLWIESKRAEIDELRFIPHPKEFELYWDI

SEQ ID NO: 9226 - protein, 146 aa, Buchnera aphidicola
MANILLLDNIDSFTYNLVDQLRNTQIHVVVYRNIVDIKIILHALMQLKNPILILSPGPGLPRDAGCMPDLIETVKGQVPIIGICLGHQAIVEAYGGQIGYASEIFHGQVSLINHDGLEMFQNLPPLLPVARYHSLICNRIPKDFIV

SEQ ID NO: 9227 - protein, 448 aa, Paralemanea annulata
LALFRVTPQPGVDPIEASAAIAGESSTATWTVVWTDLLTACDLYRAKAYKVDAVPNTSDQYFAYIAYDIDLFEEGSISNLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGVDVVLQFGGGTIGHPDGIQAGATANRVALESIVIARNEGRDYVTEGPQILRDAAKTCGPLQTALDLWKDISFNYTSTDTADFVETPTANV

SEQ ID NO: 9228 - protein, 383 aa, Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 9229 - protein, 761 aa, Panax ginseng
MWRLMTAKGGNDPYLYSTNNFIGRQTWEFDPDYGTPAERAEVEEARLHFWNNRYQVKPSSDVLWRMQFLKEKNFKQIIPQVKVEDGEEITYEAATTTLRRAVHYFSALQADDGHWPAENAGPLFFLPPLVMCLYITGHLNTVFPAEHRIEILRYIYCHQNDDGGWGLHIEGHSTMFCTALSYICMRILGEGRDGGENNACARARKWILDHGSVTAIPSWGKTWLSILGLFDWSGSNPMPPEFWILPPFLPMHPAKMWCYCRMVYMPMSYLYGKRFVGPITPLILQLREELYAQAYDEINWRKVRHNCAKEDLYYPHPLIQDLMWDSLYIFTEPFLTRWPFNKLREKALQTTMKHIHYEDENSRYITIGCVEKVLCMLACWVEDPNGDYFKQHLARIPDYIWVAEDGMKMQSFGSQEWDTGFAIQALLASDLIDEIRPTLMKGHDFIKKSQVKENPSGDFKSMHRHISKGSWTFSDQDHGWQVSDCTAEALKCCLLFSRMPTEIVGDKMEDNQLFDAVNMLLSLQSKNGGLAAWEPAGSSEWLELLNPTEFFEDIVIEHEYVECTSSAIQAMVMFKKLYPGHRKKEIEVSITNAVQYLEDIQMPDGSWYGNWGVCFTYGTWFAMGGLTAAGKTYNNCQTLHKAVDFLIKSQRSDGGWGESYLSCPNKEYTPLEGNRSNLVHTSWAMMGLIHSRQAERDPTPLHRAAKLLINSQMESGDFPQQEITGVFMKNCMLHYAASRNIYPLWALAEYRKNVRLPSKSV

SEQ ID NO: 9230 - protein, 1446 aa, Oryza sativa
MKVGFDDAADKADSMAMYKAGLVSPRENKIVDRSSAKREALQSIFDNVTEIECSGSSSSSSRRRRRSGTSGEGAMGLLTKNPRSADEERSRCPYSKQELVKKVESLCDDVCLSAVVDEQGRCAREATEWKKLVDQPKAASGRALIIELETRPRKERTIFRPSWMVSLVNVASGYSRVLLLLMSVILTPSLAASESISAEKATLSDELTHYEHFQRELDAAKGLHEELVKSVEPTLELFFPSRCKGKDLVQLATELVPEGPTAVRRLSEGGGRECGGRREGDSYTIMQPIPRTQCPPSVSRDRPWLPSSLRQPVMAIQPGLNTEEKNQGLLRQRGAGVDRVHQRRAHASAKRGGTVHRGPGPRGGPRRPTVGWPRGHTWDRGGEKREEQEGGGSPSAEAARRRRGKAADDEERQRRPAEKQRERSTDDDRQNQGRRRRSAGSAGEVARCGCSWRWWRREMVNVVAAFRKWIGEEEQWTGKTESEWVLRMKRKGNACERLKKRQREHLDSMAMYKGIGCGRVIASLGSLIDGIMVEFVVDDDKLRRLDGGSGSQRGRRGSSGFPLNDEIAMVVLTLRGHRLSGRYILQILVLRGHRLSGGCILQILDICVSLYTNEEVSVGPSIITVADISPSSPNPSLRLGKALTGQREAMNTEFQRKMLGAKNVRTDKFGLGLFGLGLGPNRNSTTFHICKEIMEIFNTKITKKIHPSVSPRREESWAMMMPKQQGPRKERAFLLFDKLPPSSHSQLLDVSSPPPSSCPVIHLATDGHLGTQHSEDNFREEPQSTTSLIESNRIGIEAGAHLTKKIIRSNRAELVLLFSSRSLAYLNLATAALPATPTTPRSGDPARRGAHWSGASWCCNGGPPLIRSTPPRPMDSARSWLQKLQPRDKDRGKPASPTAARKDGAAAMAEDGEEAISSTTATKVAAAKQFIENHYKDQMRSLEERKERSVPPLAHSACYRSANRSGIAIVRKCARRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNLSEFDYAVGKNINPSMDGDKLLSSSAAPRRTQQEQLLHWQKNRRMLAYSTVGTPDYIAPEVLLKKGYGMECDLWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEIAPMQTSSKAGPWRKMLSSKDTNFLNFTYKNLELSDDPEHPGIEFADTEEEPQSSSLNSTPSQLDQLPESLEPSPHSSISSEDSQSRHR

SEQ ID NO: 9231 - protein, 98 aa, Zea mays
  unsure (1)..(98): unsure at all Xaa locations
KDWSNVVVAYEPVWAIGTGKVXTPAQAQEVHASLRDWLKTNVSXEVAESTRIIYGGSVTAANCKEIAAQPDVDGFLVGGASLKPEFIDIINAATVKSA

SEQ ID NO: 9232 - protein, 565 aa, Candidatus Tremblaya princeps
MLHASGALGLIWTLSRMAILRLWGYPGGSVLGLYDEIYRCGLLRHMSVRSEPAAAYAACSFYAATRELGSCLVTSGPGITNAITGIATADADSVAVLVISGQVPLASIGMGSFQECDAIGLASPCTKGCYSLRRVLDIRRAAWEASLVAVTNKPSPVLLDFPKDVVRFTLPGVTALKLRYRRNHTAPLDVWSEPCLYVYAHLAARYIASAARPLAYVGGGSAYSVQRLAHIAWAACMPFAGSLMGLDAIPTMGSVGMVGMYGRLGSNIALQYCDLVAAMGARFDDRVVTSPARLVWRGRAVVSVNVSSSLTRNVGVSHMAMANVEHFIGTLCRLLSVRCALNGWSLRPWTILRRSWRIHQRHCRMGYVLYGNMFRRAVIGACSVCCDVGQHQMWSAQYNTAGITARRINSGGLGTMGCGLPFAMSAQTLSHGLYSLCITGNGSLQMSMHELPTLRDMGSRVIVIVLNNGSLGMVRQWQQVEHCGRYSQSASAMYACSSSIAEQQGHVGVDVLGPVHVFAAFAESRSSVRNTALLNVLHSSHECVWPMVQGGRSITNMMTSSRDIN

SEQ ID NO: 9233 - protein, 252 aa, Glycine max
MDSRTYNPRTVEEVFRDFKGRRAGLIKALTTDVEDFYNQCDPEKENLCLYGFPSEQWEVNLPAEEVPPELPEPVLGINFARDGMQEKDWLSLVAVHSDAWLLAIAFYFGARFGFDKADRKRLFNMINELPTIFEVVTGAAKKQVKEKSSVSNHSGSKSKSSSKQRASESQARQPKPLQSKDEDEELDDQDDDEHGETLCGACGEHYGTDEFWICCDICEKWFHGKCVKITPARAEHIKQYKCPSCSNKRARP

SEQ ID NO: 9234 - protein, 196 aa, Syrrhopodon armatus
GGAKKVVISAPSKDAPMFVMGVNEEKYTNEDIVSNASCTTNCLAPLAKVINDRFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASEGKMKGILGYTEDDVVSSDFITDSRSSIFDAKAGIALSDTFVKL

SEQ ID NO: 9235 - protein, 252 aa, Oryza sativa (japonica cultivar-group)
MGAEAVRVLVVDDSPVDRRVVELLLRAHCGGGGGAAAGEAAPFHVTAVDSGKKAMELLGRRRGDRDHLTPSSPAAAAAANDQAIDIVLTDYCMPEMTGYDLLKAIKALGSPNPIPVVVMSSENEPQRISRCLTAGAEDFILKPLKMNDVQRLRKCSGATRPKSAVAGDDDRCCNTAKKAAAAAAATPEQQQQQQRSSHLAGLAMVMNASSFEVSHYFQLIFKLILLAYAVLCLSQLLHRWSNGSSLLSLWCA

SEQ ID NO: 9236 - protein, 555 aa, Atriplex gmelini
MWSQLSSLLSGKMDALTTSDHASVVSMNLFVALLCGCIVIGHLLEENRWMNESITALLIGLATGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVVNDATSVVLFNAIQSFDLTRIDHRIALQFMGNFLYLFIASTILGAFTGLLSAYIIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNFAKKSQSEKVTFNQQIVIWWAGLMRGAVSMALAYNQFTRSGHTQLRGNAIMITSTISVVLFSTMVFGLLTKPLIMFLLPQPKHFTSCSTVSDVGSPKSYSLPLLEGNQDYEVDVGNGNHEDTTEPRTIVRPSSLRMLLNAPTHTVHHYWRKFDDSFMRPVFGGRGFVPFVPGSPTEQSTNNLVDRT

SEQ ID NO: 9237 - protein, 660 aa, Bradyrhizobium japonicum USDA 110
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAVPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDAVSYRLDYKGWEAAPSTASQTAWALLALMAAGEVDHPAVARGVEYLIATQNEKGLWDEQRYTATGFPRVFYLRYHGYSKFFPLWALARYRNLRNTNSRVVGVGM

SEQ ID NO: 9238 - protein, 566 aa, Pseudomonas putida KT2440
MAMFRLAIVSGSQRKLSRMQSAYTVLILLTLVSLSKLVGRVIPLPLPLVQIAAGALLAWPTLGLHVALDPELFLFLFLPPLLFADGWRIPKRELWRIRGPVVALAVGLVLFTVVGAGYFIHWLLPSIPLPVAFALAAVLSPTDAVAVSAIAQDRLPTPLMHMLQGEALMNDASGLVTFKFALAAAITGVFSLADASFSFVLVALGGLAVGVVLSWLIGRLRMWMITRGWDDPATHVVFMLLLPFAAYVLAERLGVSGILSAVAAGMMQSWLDLLPRQTSTRLLNRSVWSLLEFAFNGLIFLLLGLQLPDIIKAVVSHEATLWPTLAYRCLDVVAIFAALIMLRFIWVQSIWRSIGVVRRWRGKPALVLMPTARSCWLLTLGGVRGAVTLAGVMSIPLLIGAGTAFPERDLLIFIAAGVILLSLISACIALPILLRGVTKSPDERLHQEVQEAWRRTAEAAIHALEAEEVIDSNAPQDAAQATLATELKARLMAEYRDELESYDDSAEAKALAAQMDLLERRLRLRALRAQRLELYNLHRQHLVGDEVVRQVLGELDMSEANLGSVK

SEQ ID NO: 9239 - protein, 569 aa, Schizosaccharomyces pombe
MPDSKHWVILLFRRDGDDDDDDGQDPALQELYSSWALFILLVLLIGALLTSYYVQSKKIRAIHETVISVFVGMVVGLIIRVSPGLIIQNMVSFHSTYFFNVLLPPIILNSGYELHQSNFFRNIGTILTFAFAGTFISAVTLGVLVYIFSFLNFENLSMTFVEALSMGATLSATDPVTVLAIFNSYKVDQKLYTIIFGESILNDAVAIVMFETLQQFQGKTLHFFTLFSGIGIFIITFFISLLIGVSIGLITALLLKYSYLRRYPSIESCIILLMAYTSYFFSNGCHMSGVVSLLFCGITLKHYAFFNMSYKAKLSTKYVFRVLAQLSENFIFIYLGMSLFTQVDLVYKPIFILITTVAVTASRYMNVFPLSNLLNKFHRQRNGNLIDHIPYSYQMMLFWAGLRGAVGVALAAGFEGENAQTLRATTLVVVVLTLIIFGGTTARMLEILHIETGVAADVDSDTEIGMLPWQQSPEFDLENSAMELSDASAEPVVVDQQFTTEHFDEGNIAPTLSKKVSSTFEQYQRAAGAFNQFFHSSRDDQAQWLTRFDEEVIKPVLLERDNLKNGTKK

SEQ ID NO: 9240 - protein, 207 aa, Brucella melitensis 16M
MARGADIQSFIERLPETTLLILDEAYCETAPASAFPPFETDRPNVLRMRTFSKAYGLAGIRCGYAVGNPVAIKTFDKVRDHFAVSRMAQAAAIAALKDQAYLHEVVGKICAGRDRIAAIAEANGLHAVASATNFVAIDCGRGKDFAQAVLNGLISRDIFVRKPGTPVLDRCIRVSVGVKEQLDQFEAAFPEALEEARKICAANAENT

SEQ ID NO: 9241 - protein, 139 aa, Chlamydomonas reinhardtii
MSVPVPRSFRLLEELDRGEKGFGDGTVSYGMEDPDDIHMRNWTGTIIGPANTVHDQRIYSLKIHCDLSYPEQAPKLWFKSRVNMGCVDQRDGRIDPTKFPMLGNWKREYTLEQLLTEIRRDMSSPLNRKAPQPPEGTMF

SEQ ID NO: 9242 - protein, 306 aa, Zea mays
  unsure (1)..(306): unsure at all Xaa locations
MDHAADAHRTDLMTITRHVLNEQSRNPEPRGDFTILLSHIVLGCKFVASAVNKAGLAQLIGLAGETNVQASALCDDAAAMVARRARQGEEQKKLDVLSNEVFVKALVSSGRTCVLVSDAWADAWADAWALRFGYCVCFDPLEGSSNIDCGVSIGTIFGIYIIKDKDNVTLEDVLQPGKNMLAAGYCMYGSSCTLVLSTGTGVNGFTLDPSXLGEFILTHPDIKIPKKGXKIYSVNEGNAKNWDAPTAKFVKKCKYPEDGSPPRSLRYIGSMVADVHRTLLYGGIFLYPAXDEKNPNGKLKSSSASS

SEQ ID NO: 9243 - protein, 310 aa, Nostoc punctiforme
MSIIVFGSINIDLVATTPRLPVPGETLLGEEFFKVSGGKGANQAVALAKLGIPTQMVGRVGADDFGVELVNNLQSSGVQIDNIFVDETVSSGVAIIAVNHAGENQIIVIPGANGRVNQEDVERLSQLLPEATALLLQLEIPITTVIAAATAARKSKIRVILDPAPAQSNFPDELYPLVDIITPNEVEAAQLVGFPVDGEEQAAKAAEVLLQRGVKCAIVKLGAKGVFCATAEEKFFVPVFPVHAVDTVAAGDAFNGGLTAALFAGFSLHQAVVWGAAAGALATTKSGAQTSLPDRFTFDAFLREKASVRD

SEQ ID NO: 9244 - protein, 170 aa, Lactococcus lactis subsp. lactis
MELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 9245 - protein, 253 aa, Staphylococcus aureus subsp. aureus Mu50
MRTPIIAGNWKMNKTVQEAKDFVNALPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 9246 - protein, 320 aa, Persea americana
MDSFPVINMEKLEGQERAATMKLINDACENWGFFELVNHSIPVELMDEVERLTKEHYKKCMEQRFKELMASKVEGAVVDANDMDWESTFFIRHLPVSNLSEIPDLTDEHRKVMKEFAEKLEKLAEQVLDLLCENLGLEKGYLKMAFAGTTTGLPTFGTKVSNYPPCPRPELFKGLRAHTDAGGLILLFQDDRVAGLQLLKDGEWVDVPPMNHSIVINLGDQVEVITNGKYKSVMHRVVAQTDGNRMSLASFYNPGSDAVIFPAPALVEKEAEEKKEVYPKFVFEDYMNLYAGLKFQAKEPRFEVMKMKAVETANLSPITT

SEQ ID NO: 9247 - protein, 477 aa, Grateloupia versicolor
KNERYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILQDAAKTCGPLQTALDLWKDITFNYTSTDTADFVETPTANV

SEQ ID NO: 9248 - protein, 520 aa, Brassica napus
MESSISQTLSQVLDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHIKKKENQNSVDAGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTFLKCTLNETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPCTRLICSV

SEQ ID NO: 9249 - protein, 391 aa, Streptococcus salivarius
MAEKIVMKNGQLQVSDRPIIPFIEGDGVGHDIWKNAQAIFDKAVEVAYEGKRHIEWQELLAGKKAYDKTGEWLPKETLEAIRESLVAIKGPLETPVGGGIRSLNVALRQELDLYACVRPVRYFDGVASPLKEPEKTNITIFRENTEDIYAGIEWEAGTADVKRVIEFLQTEMNVNKIRFPESSSIGIKPISIEGSKRLIRSAIDYALKNNLKKVTLVHKGNIQKFTEGGFRKWGYEVAQEDYKEELLAGRLEINDIIADNFLQQILLNPEKFDVVALTNLNGDYASDALAAQVGGIGISPGANINYQTGHAIFEATHGTAPDIADQDKANPCSVLLSGCMLLDYIGWTEAAQLITSAIEKTFKADIFTADLAFGKQAYSTSAFSNQILSIM

SEQ ID NO: 9250 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 9251 - protein, 515 aa, Glycine max
KSRRRKTAAWLRECVLQLGPTFIKLGQLSSTRSDLFPREFVEELAKLQDRVPAFSPKKARGFIESELGAPINILFKEFEDRPIAAASLGQVHRAILHNGEKVVVKVQRPGLKKLFDIDLQNLKLIAEYFQRSETLGGPTRDWVGIYEECATILYQEIDYINEGKNADRFRRDFRNIKWVRVPLVYWDYTASKVLTLEYAPGIKINEVDMLASRGYDRLRISSHTIEAYLIQILRTGFFHADPHPGNLAVDVDEAIIYYDFGMMGEIKSFTRERLLELFYAVYEKDAKKVMQCLIDLGALQPTGDLSSVRRSIQFFLDNLLSQTPDQQQTLSAIGEDLFAIAQDQPFRFPSTFTFVIRAFSTLEGLGYILNPDFSFVKIAAPYAQELLDIRQKRPTGPQLVEEIRKQADDARTNSISMPYRVQRIEEFVKQLEAGDLKLRVRVLESERAARKATILQMATMYSVLGGTLLNLGVTLSSQGNQAFANGSFIGAGILGALFLRSMQRLKKLDKFENMI

SEQ ID NO: 9252 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 9253 - protein, 435 aa, Haemophilus somnus 129PT
MVIMKKFILLGLLLSFSSSSIAELSDWIKPISDISSGDTAWVMISAILVLFMTIPGLALFYGGMVRKKNVLSTMAQSFAVSGLIAVIWLCFGYSLSFTPNNAFIGGMDRFFLQGLNVFTEQKMLTVYPGAGTIPESVFMIFQMTFAIIAGAIITGATVERMKFSALLLFVGLWSLLIYVPTAHWVWGIGGWLVNDGVLDYAGGTVIHINAGVAGLVAAIVIGKRVGYRHEVMMPHNLVLTLIGTAMLQIGWFGFNAGSALAADARAGMALATTQISASVGALTWILVEVFCKHKPSALGLASGAVAGLVGITPAAGFVSVQSALFIGMITSAVCFVGVMKLKYWFRYDDTLDAFGIHGLGGIVGAVLTGIFVSPDISATETTLWTQIESVLITIIFSASGSFVLLKIIDKTVGLRVERDEERQGLDLSCHGERIE

SEQ ID NO: 9254 - protein, 220 aa, Zea mays
  unsure (1)..(220): unsure at all Xaa locations
MAAAAVAADSKIDNLRDAVAKLGEISENEKSGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGXKDGWYPPGHGDVFPSLNNRGKLDTLLSQGKEY

SEQ ID NO: 9255 - protein, 956 aa, Azotobacter vinelandii
MKTSRLWLKRSTLPAFISRRATCLAGSYCSKASARPRRIRSERRTSTGRLQQVARQSWHRLWRYLTQVSRRSGSAAARIGGFFIGGRQWWRARDDSDKSARRRIRLAASPALCMLDRVGACCCAVEDRTLVLSLLPSEVAVMPEVSPVPEEVAAFRARIVDKLRYAVGKAPEHAVGFDWFEAVALATRDHLVETWMDHASRAYRQSSKRVYYLSLEFLVGRLLQATLSNLGLLEVARAALAELGVDLERIRDLEPDAALGNGGLGRLAACFMESMATLGIPAYGYGIRYDYGLFRQVIVDGWQQEQTETWLEFGNPWEFERPEVSYRISFGGSVVCTEGEGGRQCHVWQPAEDMRAIAYDTPIVGWRRHSVNTLRLWRGRPETDLHLERFNAGDHLGAVAESVRAESISRVLYPADDTAAGQELRLRQEYFFVSASLQDLLRRHLKQRGNLLDLPEYAAIQLNDTHPSIAVAELMRLLLDVHGLDWDKAWELTVATLSYTNHTLLPEALESWPVALMERLLPRHMQIIYLINAQHIDHLRAQGMHDFDLLRAVSLIEEEHGRRVRMGNLAFLGSHCVNGVSTLHTELMRKTVFAQLHGLYPERISNKTNGITFRRWLYQSNPRLTALLVDTLGESLLDDPEHLLGGLEAQAGQTSFHQHFRTLRRQNKEALARLVQDRLGVVLDPEALFDVQVKRIHEYKRQLLNLLHCVALYQAIRDEPGVDWGPRVKILAGKAAASYHQAKLIIKLANDIARTVNGDPTLRGRLKVVFLPNYNVSLAEVIIPAADLSEQISTAGMEASGTSNMKFALNGALTIGTLDGANVEMSERIGSENLFIFGLGAQQVEARRRSGEVGGAAAVAASPRLSEVLTAIRSGVFSPDDPGRYAGLVDGLLQHDNFMVCADFDAYWQAQREVDARWRVPSQWWRSAVLNTARMGWFSSDRTIREYAREIWRLPE

SEQ ID NO: 9256 - protein, 65 aa, Triticum aestivum
  unsure (1)..(65): unsure at all Xaa locations
SSGRPGRSRSMDPARQERFINRWIDELSDPRLTXXIKAMWLSXXSQAAKSLGQKLASRLSSKPSM

SEQ ID NO: 9257 - protein, 138 aa, Salmonella enterica
LGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 9258 - protein, 309 aa, Pseudomonas aeruginosa PAO1
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 9259 - protein, 87 aa, Zea mays
LNTMDPTKFRPSSSHDTTVTTTNAGAPVWNDNEALTVGPRGPILLEDYHLIEKVAHFSRERIPERVAHTRQRLLLRAFLVLSQPTSR

SEQ ID NO: 9260 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 9261 - protein, 121 aa, Triticum aestivum
MARVPVLLLALFAAALAAAPAAALGGRGARVGGWGPIPDVTDAHIQELGGWAVEQHARLTSDGLRFRRVTRGEQQVVSGMNYRLFVDAADGSGKSAPYVAEVYEQYWTKTRQLTSFKPAAN

SEQ ID NO: 9262 - protein, 306 aa, Shigella flexneri 2a str. 301
MRFRQLLPLFGALFALYIIWGSTYFVIRIGVGSWPPLMMAGVRFQAAGILLLAFLLLRGHKLPPLRPLLNAALIGLLLLAVGNGMVTVAEHQNVPSGIAAVVIATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 9263 - protein, 246 aa, Picea smithiana
YTYTLRNKGPEDVIVRVIYCGICHSDLVQMHNEMGMSNYPMVPGHEVVGVVTEIGSEVKKFKVGEHVGVGCIVGSCRSCSNCNGSMEQYCSKRIWTYNDVNHDGTPTQGGFASSMVVDQMFVVRIPENLPLEQAALLLCAGVTVYSPMKHFGMTEPGKKCGILGLGGVGHMGVKIAKAFGLHVTVISSSDKKKEEALEVLGADAYLVSKDAEKMQEAAESLDYIMDTIPVAHPLEPYLALLKTNGK

SEQ ID NO: 9264 - protein, 138 aa, Nocardia brasiliensis
DQVPDFIRSQKRLPGNGLRDHNMQWDFWTLRPESAHQVTWLMGDRGIPKTYRHMNGYGSHTYQWINAAGERFWVKYHFKTDQGIDYLTQADADRIAGENADYHRKDLWDAIERGEFPSWTLHVQVMPVAEAENYRFTR

SEQ ID NO: 9265 - protein, 383 aa, Escherichia coli
MNAPFTYSSPTLSVEALKHSIAYKLMFTIGKDPVVANKHEWLNATLFAVRDRLVERWLRPNRAQLSQETRQVYYLSMEFLIGRTLSNAMLSLGTHEDVQGALEAMGLNLEELIDEENDPGLGNGGLGRLAACFLDSLATLGWPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFDQGDYFAAVEDKNHSENVSRVLYPDDSTYSGRGLRLRQEYFLVSSTIQDILSRHYQLHKTYDNLADKIAIHLNDTHSVLSIPEMMRLLIDEHQFSWDDAFEVCCQVFSYTNHTLMSEALETWPVDMLGKSLPRHLQ

SEQ ID NO: 9266 - protein, 523 aa, Oryza sativa
  unsure (1)..(523): unsure at all Xaa locations
MGSLGEADGKKENEEEDVANGELAAEPGEHECGEIWRATRHSAPSRYESMATPPSSHCVSTLHCSRHGYIVLEDKVEARRKKEKREAKKRGLPLLDCFWWRDWQGGLTGVDALDTSGGAMHVMSSRGESGSGRPELRHASAVHLFARKLPKQQIIQSARTQIMQPSQRSRRPPRLSRRNAIRQSAYVARPASQLSPPSESDQPAFWYSTEESVLEERVVEDEVGDHAEAGGAEAAALVVEEASTSSSSAVSVHAAMVIRRSILNWSKLDLIGAGSSGRVYKAVAEDGFVFAVKEASLIGPESYTKQTACQLKQEILLLSRLEHKNIVQYFGAKMGETVLCIFLEFVSEGSLVSVYEKQQLEESTISXYTRQILNGLAYLHHHNVMHRDIKCANILVDKNGAVKVGDFGLAKEVTSFLVSVSCTGSVYWMAPEVVVRGNPYGYSADIWSLGCTVLEMLTQRIPYPDDNWVSVFYQIGRGQLPPVPGSISPVSRDFIHKCLQVNPDDRPSADELLNHPFLNHAAS

SEQ ID NO: 9267 - protein, 403 aa, Oryza sativa
MAAMPGGPDLAGAGGAVAVAVDAMQVDDPPRASAEEKHGPTIMGGNDPVTGHIISTTIGGKNDEPKRTISYMAERVVGTGSFGVVFQAKCLETGETVAIKKVLQDKRYKNRELQIMRSMDHCNVISLKHCFFSTTSRDELFLNLVMEFVPESLYRVLKHYKDMKQRMPLIYVKLYMYQIFRGLAYIHTVPGVCHRDIKPQNILVDPLTHQVKLCDFGSAKMLIKGEANISYICSRYYRAPELIFGATEYTTSIDIWSAGCVLAELLLGQPLFPGESAVDQLVEIIKVLGTPTREEIRCMNPNYTEFKFPQIKACPWHKIFHKRMPPEAIDLVSRLLQYSPNLRCTALEACAHSFFDELREPHAKLPNGRPFPPLFNFKQELANTHPELVSRLLPEHAQRHSGF

SEQ ID NO: 9268 - protein, 336 aa, Hypocrea ceramica
MVPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 9269 - protein, 116 aa, Zea mays
  unsure (1)..(116): unsure at all Xaa locations
AREAMDEXTSKIFMGGKTTIVLHNTSEDSLLAAPIILDWVLLAELTTTIQFKAENEGKFHSFHPITTILSYLTKAPLVPPGTPVVNXLSNQRAILENIMRACVGLAPENNMILEYK

SEQ ID NO: 9270 - protein, 470 aa, GIBBERELLA ZEAE PH-1
MHFSLVSAAVLGLVGSVNAWGGIAPDSSRFRTLERHGLTAFQHAATDSTLEFTSNSGICETTPGVDQHSGYLSVGKNHSMWFWFFEARNNPEDAPLAIWLNGGPGCSSMVGLFTEHGPCHFVGNDTEPTLNPYSWNEYANMLYIDQPIGTGFSTGTEDVNSTAQAAPYIWKFMQAFLDRFPKYKSREFGLFTQSYGGHYGPEFADFFLNQNEQIDDGHLDAHKIDMVALGINNGWIEPKRQYKSYATYANRNPYKKILTNKQLRTSLDSYNKYCLPAMENCTELEGQDEECAKADEACNTQMFTNLVIAGGTDFNVYDVRIGQNDVDPPDTFLEYITRAEVMDAIGANTRFAECSDTVYANMAKTGDGARSYVGPLADVVKRGVNTLIWAGDTDWICNWEGVLWASYALEWPGQKEFVAAPFNNYTVDGKAQGRYKTVDNLSFLKVWEAGHSVPYYPQQNPKRRCRCLSR

SEQ ID NO: 9271 - protein, 366 aa, Solanum tuberosum
QMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFCQPSFISISEVMNEVVGCNDDLVHIVYSLSKDLGFPGFRVGIIYSYNDVVVNIARQMSSFGLVSTQTQRLIASMLSDTIFVENFIAKSAMKLSQRHDLFTKGLGQVGITTLKSNAGLFIWMDLRRFLENSTFDNELKLWHIIINKVKLNVSPGCSFHCSEPGWFRVCFA

SEQ ID NO: 9272 - protein, 1033 aa, ASPERGILLUS NIDULANS FGSC A4
MDYRALWRRDGAEEFLKLIQDPFKSAFQTNAVWASLATSAVVAIVLALLFSLFRPRHTLVYAPKVKHADRKHAPPPVGKGLFAWIKPVIRTKEAELVDCVGLDATIFIRFTKMCRNIFIFLSIIGCGVMIPVNLTQSQNTDGATAFVVMTPLYVKVNAIWSQVVCAWAFNIIITFFLWRNYKAVLALRRRYFESSDYQRSLHARTLMITDIPPDLRTDEGFLRLTDELNPTAALPRSSVGRNVKGLPKLIKEHEELVRKLESVLAKYLKNPDRLPPSRPTMRPPRGHRDEDGSGKVDAIDYLTDRIQRLEEEIRHVRASIDKRNAMPYGFVSWDKIEHAHAVAYVARNKHPRGTTIRLATRPHDLIWENLSLSKSARKWKAFVMFLWVTALTVVWIAPNALIAVFLSNLSNLGSVWPAFQTELDRNRKVWAAVQGILSPAVTSLFYLLLPIIFRRLSARTGDATKTLREQHVLRHLYSFFVFNNLIVFSLFSAVWTFIAAVIDLKNKNEDPWQAVQDGQFYIKAFSAMCNVSPFWVTYLLQRNMGAAIDLVQFVHLIWVWFAKTFLAPTPRQTIEWTAPPAFDYASYYNYFLYYSTIAICFATLQPIVLPVTALYFGLDAMMKKYMLMYIFVTKNESGGQFWRVLFNRVVFAAILSNVIIGLVAKARGTWNMVYCVVPLPFLMLLFKWYCMRTFDDDCTYYNKANLSDTEALAASKSSKSAGDRLSSKFGHPALFKPLITPMVHAKAADALKQIYRGRLGGNEAEGDYSDIVMDPMMKSQPGKTMPDTSAPFEVVPEHHLDFAYYKDRADFQEEFGGGIYGRPEDLMTERSHTPRSALGDWSPTSSRAPSPAPSVPSLPMLQPEAYDPRLNQGMHPVFRPPPFRTGSGMSRGLYQHQNESETELLGQVQQPAGVSMQPWRPGGGYGPVDQDDHAFTSYEQYLVSIVPENYTLAVRQQPQAPGACLPITGLGRSLFPDNTRTTDSRSLGSPSATVARPELYDAVAISNSRCLYKPALCKLNQQPIRRCLVQHLN

SEQ ID NO: 9273 - protein, 267 aa, Triticum aestivum
  unsure (1)..(267): unsure at all Xaa locations
GPNHHYRAANSTSRGPRRSRPPANHAALSPPRLSAQAATISSVSHSSTHCSVVRAQHSSLRSIVSTSPRXKTAFRGVPLVDSRWLRRAGARRRLVQVNAKTAGAAQEHRGGGRHAGQPPTWARHRATAGVDSGVEAKVNFAKSGAQVKPNTVFFXVSCAGGDIGVKRLPEWPAPPRFGPAGYVIHRRTRAXTHICLDCGYIYFLPKAFEEQPDEYGCPQCNAPKKRFARYDVESGKPIGGALPPLTVIVSLVIGIAGIGALLVYGLQ

SEQ ID NO: 9274 - protein, 424 aa, Atriplex prostrata
YLRAIAAKITERKDHFVKLETLDSGKPFDEALLDIDDVAGCFEYYADQAEALDAKQKAPIALPMDTFKSHVLRQPIGVVGLISPWNYPLLMATWKVAPALAAGCAAILKPSEMASVTCLELADVCKEVGLPPGVLNILSGYGPEAGGPLASHPDVDKVAFTGSTATGSKIMSSAAQLVKPVTLELGGKSPIILFEDVDLDQAAEWAAFGCFWTNGQICSATSRLLVHESIAAEYLDKLVKWCKNIKISDPFEDGCRLGPVVSKGQYEKVLKFISTAKSEGATILCGGSRPEHLKKGYFIEPTIISDVSTSMQIWKEEVFGPVLCVKTFSSDEEAIELANDTQYGLGAAVLSKNLERCEKVTKALEVGIVWVNCSQPCFCQAPWGGAKRSGFGRELGEWGIENYLNIKQVTSDISDEPWGWYKSP

SEQ ID NO: 9275 - protein, 90 aa, Lycopersicon esculentum
NRAGKSTYVKFHRKPTCGVMSLLEEEADRVGGANHSHATQDLYDSTAAGNYPEWKIFIQTMDPDHEDRFDFDPLDVTKTWPDDILPLQPD

SEQ ID NO: 9276 - protein, 375 aa, Glycine max
  unsure (1)..(375): unsure at all Xaa locations
MQRLKLQLVLFLSISTCHTVFSFTDGLLPNGNFEQGPKPSQLKGSVVTGHDAIXPNWTISGFVEYIKSGQKQGDMLLVVPEGDYAVRLGNEASIKQKLKLIKGSFYSITFSAARTCAQEEKLNVSVVPTTEKRDWGIIPIQTMYGSNGWESFTCGFRADFPEAQIVIHNPGKEEDPACGPLIDSVALKVLYPPKRTRANLLKNGNLEEGPYIFPNSSWGALIPPHIEDSHGPLPGWIVESLKAVKYIDSDHFAVPEGKRAIELVAGKESALAQVVITTIGKTYDLTFAVGDANNECEASMMVEAFAGANTVQVPYQSKGKGGFVRGKLRFKAVSTRTRLRFLSTFYTMKSDNSGSLCGPVIDDVKLLGVRYPTHA

SEQ ID NO: 9277 - protein, 399 aa, Zea mays; identical to SEQ ID NO: 5371

SEQ ID NO: 9278 - protein, 312 aa, Escherichia coli O157:H7 EDL933
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 9279 - protein, 482 aa, Pseudomonas putida KT2440
MPSEHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFISIHIFGVGEALKLMFIITAIAAIALAVFLIGMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGSTWMGGFVNLVGLAGLIASFFSIIYAYSRQIFALSRAGYLPRKLSETNKSKAPVLALVIPGIIGFALSLTGQGDLLILVAVFGATLSYVLMMAAHITLRIRRPKMERPYRTPGGIFTSGLALVLACIAVVAGFLVDPRVVIGAAVIYAVLIAYFAFYSRHHLVAGTPEEEFAAIQKAEEALH

SEQ ID NO: 9280 - protein, 178 aa, Oryza sativa
  unsure (1)..(178): unsure at all Xaa locations
MAPTVMASSATSVAPFQGLKSTAGLPVSRRSNSAGLGSVSNGGRISCMQVWPIEGIKKFETLSYLPPLTVEDLLKQIEYLLRSKWVPCXLEFSKVGFVYRENHRSPGYYDGRYWTMWKLPMFGCTDATQVLKXELEEAKKAYPDAFVRIIGFDNVRQVQLISFIAXYSPRGCEESGGN

SEQ ID NO: 9281 - protein, 624 aa, Lipomyces kononenkoae
MLLINFFIAVLGVISLSPIVVARYILRRDCTTVTVLSSPESVTGSNHVQLASYEMCGSTLSASLYVYNDDYDKIVTLYYLTSSGTTGSTLALILPVWSNNWELWTLSAIAAGAVEITGASYVDSDTSVTYTTSLDLPLTTTSASVPTGTAANWRGRSIYQVVTDRFARTDGSITYSCDVTDRVYCGGSYRGIINMLDYIQGMGFTAIWISPIVENIPDDTGYGYAYHGYWMKDIFALNTNFGGADDLIALATELHNRGMYLMVDIVVNHFAFSGNHADVDYSEYFPYSSQDYFHSFCWITDYSNQTNVEECWLGDDSVPLVDVNTQLDTVKSEYQSWVKQLIANYSIDGLRIDTVKHVQMDFWAPFQEAAGIYTVGEVFDGDPSYTCPYQENLDGVLNYPVYYPVVSAFQRVGGSISSLVDMIDTLKSECIDTTLLGSFLENQDNPRFPSYTSDESLIKNAIAFTILSDGIPIIYYGQEQGLNGGNDPYNREALWPTGYSTTSTFYEYIASLNQIRNHAIYIDDTYLTYQNWVIYSDSTTIAMRKGFTGNQIITVLSNLGSSGSSYTLTLSNTGYTASSVVYEILTCTAVTVDLSGNLAVPMSGGLPRVFYPESQLVGSGICSM

SEQ ID NO: 9282 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYSDAYVRVIGFDNLRQVQCVSFIAFRPPGCE

SEQ ID NO: 9283 - protein, 355 aa, Zea mays
  unsure (1)..(355): unsure at all Xaa locations
MRQISSLLQGLARSLSVGRDRDRDRDRKGNGAGDRKTAVPAVLRTSGTLWGDGSDTFAAVCSRRGEKGINQDCSIVWEGFGCXRRAPIFCGIFDGHGQWGXHYVAKAVRDSLPPSLLCHWQEALALASLIDDGEKKLGDCQFDLWKRSYVAACAAVDDELRRSRRLDAVQSGCTALSIVKQGDLMIVANVGDSRAVLGTTSGDGTIVAVQLTVDLKPNLPQEKERIRRCNGQVYCLADEPGVHRVWQPSRESPGLAMSRAFGDYCVKDCGVISAPEVTQRRIGSSDQFVILATDGVWDVLSNDEAVHIVAGTXDRAKAAKRLVECAVRAWRRKRRDIAVDDCSAICLFFHPPPPP

SEQ ID NO: 9284 - protein, 460 aa, Chondrus armatus
WDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKALGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKNISFNYTSTDTADFVETPTANV

SEQ ID NO: 9285 - protein, 221 aa, Salmonella enterica subsp. enterica serovar Thompson
VDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 9286 - protein, 180 aa, Petunia x hybrida
MASSVMSSAAVATSTNAAQASMVAPFTGLKSAASFPVSRKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGY

SEQ ID NO: 9287 - protein, 147 aa, Triticum aestivum
HGLRGTAVPRRQPLKGQARVAALRELRSLASNHQSVTKAIAEAGGVSLLTSLLGPFTSHSVGSEAVAILVSGVPLDADAKAALMQPAKVSLVVDMLNEGAVDTKINCVRLIRILMEEKGFRPETVASLSLLAGSMRLVRDKRHQDGV

SEQ ID NO: 9288 - protein, 668 aa, Oceanobacillus iheyensis HTE831
MVRKFFLLFLSIVLTFTTLPMTAFAEEEDEIQTMINNMSVEEKVGQLFIVHVYGQTPTDPNYESTNLTNNRGGKNFQEVIENYHIGGIIYFNWSQNIGTPLEKQQVHDLSNGLQDIALEQDSEIPLFVSTDQEGGIVQRVISPGTVFPGNMAIGATNSIDFASRSGEILGKELDALGINMNFAPTVDVNLNPANPVIGVRSFGEDPDMVSQLGAAQITAYEDQDVVATAKHFPGHGDTDVDSHYGLPVIDHDLETLHEVDLPPFQAAIDAGVGAIMTGHIVVPALDDSGMPATLSYPILTELLREDMGFEGLIITDSLGMSGANVVPPERVAVESFLAGADILLNPPDVPVAYEGVMDAVESGEISEERLDESVYRILSAKMEYGLFEDPYTESNKLDVIGSESHLKTASEIAEKSITLLKNNGDVLPLQEDEEVFITGPQAAYPNKIANLLGEQDIQSTHYSTATSPTDNQIAEAVDRAESADKVVVTTYTANTNERQQMLVEALQELDKPIVVSAHRNPYDLMAFPNVDAYLNSYSYLDVSLDAVAASLIGDINPSGKLPVTIPDVNEIGDGVDYVGAESANDIKSLVDELHTNEELNSDEAKKAFERHLTAVAQFEKTNQSAKVIKHLESFQTLIDHYNEQEALSKKAFNYLETTSLRLIDQWED

SEQ ID NO: 9289 - protein, 265 aa, Desulfovibrio desulfuricans G20
MWTWTRAFSSVPCGCATAWSAGRREQASSTTRCPKKNGKSAATRPEWCVRPSRVRMAADQRETAMFLLIDNYDSFTFNLVQAFSKGGLTPQVRKNDDPELPALAQSGTLTMVCISPGPGNPAGAGLCLEFLDRLPRHVPVLGVCLGHQVLGAYAGAAVEVGPRIMHGKASRVVHQGTGLFEGVCNPMTVGRYHSLVVRAEQCPGTLEVLAVTDAAVDDGCVMAMRYRDRPWMGVQFHPESVLTPQGETLLQNFCRMATACTAGAV

SEQ ID NO: 9290 - protein, 316 aa, Saccharomyces cerevisiae
MSITTTRRRNQDSVCCKATRASIKVEAVSGQTVFEKQKLLHNFDELPEWQKDNDKILTGYVRETLSWKKCLYSLFYWNNETVNIYTHLVPAIVYFVFAITLTNYFLIPVFPSTSWSDYTVINIFLMGAFSCLMCSSCFRCMKQHSEKQSNFWSKLDYLGIISLISCSMIPIIYFGYFDHISYFSLFTIVTLVLATFCTVCVLHDKFNTSTFRPFRAMFFILFGFSGLLPLTTGFFKFGIQGVLNRIKVSFVFWEALFYISGAVIYGFRIPETLAPGKFDFFGSSHQIFHIMVVLGSVCHLKAIIDSYKLMHSHIHP

SEQ ID NO: 9291 - protein, 206 aa, Acacia mangium
VLCDAEVALIVFSTKGKLSHYSSDPCMEKIIERYERYSYAERPQAAPDRSPTENWTLEHAKLKARMEVLQRNQKHYRGEDLEGLSLKELQNLEHQLDSALKHVRSRKNQLMYESISEFQKKDKKLQEQNNLLAKEIKEKEKALAEKAREEKHNDEDALVQPQLPPSNIGEIVEARGGAEDNEATTTHHQPRSGPLLPSWMLPPISE

SEQ ID NO: 9292 - protein, 346 aa, Glycine max
  unsure (1)..(346): unsure at all Xaa locations
MAHFTSSGKSDNLTKEDCIGKSALVVCFGEILIDFVPTVCGVSLAEAPAFKKAPGGAPANVAVGISRLGGSSAFVGKVGADEFGYMLVDILKKNNVETSGMKFDPNARTALAFVTLRADGEREFLFFRNPSADMLLQESELDKNLIKKAKIFHYGSISLIDEPCKSAHLAAMXLXKESGCIPSYDPNLRLALWANXWKAARDGIKWVYXGGSKAGXVLKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALYFANVCGAITVTERGAILALPTKEAVFQFAAT

SEQ ID NO: 9293 - protein, 512 aa, Medicago truncatula
MAGGVLPVDSTPVAVTAINIGGKLTLSIIITCIVAASGGLLYGYDLGVSGGVTTMVPFLQKFFPDILRKAASAEVNMYCVYDSQILTLFTSSLYLAGLVSSIAASKVTAAYGRRNVIIIGGALFIAGGAINGGSENIPMLILGRVLLGFGVGFTNQAAPLYLSETAPPKWRGTFNTGFQFFLGIGVVAAGCINYATAKHTWGWRLSLGLAVVPAAVMTIGSFLITDTPNGLVERGKIEQAKQALRKIRGSSVDIEPELEELIKWTEIAKSVQQEPFKTILKREYRPHLVMAFAIPFFQQLTGINIVAFYSPNLFHSVGFGHDGALLSAIILGSVSLLSNLISAGIVDRIGRRFLFISGGIMMLVCLIAVSIVLAVVTGVDGTKDISKGNAIVVLVLLCFYSAGFGWSWGPLTWLIPSEIFPVKIRTTGQSIAVAVQFIIIFVLSQTFLTMLCHMKFGAFVFYAFWVIVMTLFVIFFLPETKGIPLESMYTIWGRHWFWSRYVKGQEVLENLP

SEQ ID NO: 9294 - protein, 180 aa, Lycopersicon esculentum
MASSVISSAAVATRSNVTQASMVAPFTGLKSSATFPVTKKQNLDITSIASNGGRVSCMQVWPPINMKKYETLSYLPDLSDEQLLSEVEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 9295 - protein, 179 aa, Zea mays
  unsure (1)..(179): unsure at all Xaa locations
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPXLKVYLQKYREMEGDSKLTAKSSDGSIKKDALGHVGASSSAVQGMGQQGTYNQGMGYMQPQYHNGDISN

SEQ ID NO: 9296 - protein, 558 aa, Haemophilus somnus 2336
MNGANLVVECLKAHGVTSLFGYPGGAIMPVYDAIYDSGLDHLLCRNEQGAAMAAIGYARSTNKVGVCVATSGPGATNLITGLGDALMDSIPIIAITGQVASNFIGTDAFQEADILGLSLACTKHSFIVQHIDELPEIIAKAFQIAQSGRPGPVLIDLPKDVQFAPTSLKPIVYPKIADSLQNLVALEQAKNLLSQAKRPVLYVGGGVGMAKSSDGMSGVKAIRTFLDITNIPSVSTLKGLGTIPPKHPLYMGMIGMHGTKAANYAVQECDLLIACGARFDDRVTGKLDTFAPHAKVIHIDIDVAEINKLRKADVGLQGDLVEAVTNLAQLLDIEPWRKDIEQLKASFDFNYIENTEDKEIEPCALLHTLSERKAKNAVITTDVGQHQMWSAQHMKHYEPENYITSAGFGSMGFGLPAAIGAAKARPQDPVILITGDGSLMMNIQELGSIKRGNLPIKILLLDNQRLGMVRQWQSLFFHGRHSHTVLDDNPDFVTLASAFGIAGERIEKASEVSDALDRLLNAKEAYLLHVCIPDEENVWPLVPPNTCNSNMIEEDIGV

SEQ ID NO: 9297 - protein, 375 aa, Zea mays
MSVAAAAALGRADELRALDDTLAGVRGLVASGAKQVPHIFRVPYPEELLQHEQPPAAATVPVIDLSGDRAAVIDAVRGAAAGWGFFQVTGHAVPEQVMSAAVAAMRAFHEADGGEGSDKARLYSREPGRAVKYHCNFDLYQSPVANWRDTVYLRMAPDPPAADELPEICRLTNKVADSQFARDALFEYAKQVKDLGHRLFGLLSESLGLNPSYLTDIECDQGQIILGHYYPPCPQPELAIGTSRHSDSGFLTILLQDKVGGLQILHDGQWVDVAPTPGAFIVNIGDLLQLVSNDKFSSVEHRVVAKNAEARVSIACFFSTHFHPASTRMYGPIKELLSEENPPLYRETLVREYVARYYSVGLDGKQKTALADFRL

SEQ ID NO: 9298 - protein, 476 aa, Glycine max
MPEETTSIDYVMEAASGPHFSGLRLDGRVPSSATAAAASSTPDSTLTLDSLPNQPFVIGVSGGTASGKTTVCDMIIQQLHDHRVVLVNQDSFYRGLNPEELERVHEYNFDHPDAFDTEQLLECTRKLISGQGVHVPIYDFKKHQRSSDSFRQVNASDVIILEGILGFHDQRVRDLMNMKIFVDADADVRLARRIRRDTVGRGGDINSVLEQYAKFVKPAFDDFVLPSKKYADVIIPRGGDNHVAIDLIVQHIRTKLGQHDLCKIYPNAYVIQSTFQIRGMHTLIRDRDISKHDFVFYSDRLIRLVVEHGLGHLPFTEKQVVTPTGSVYTGVDFCKKLCGVSIVRSGESMENALRACCKGIKIGKILIHRDGDNGKQLIYEKLPKDISERHVLLLDPVLATGNSANQAIELLIQKGVPESHIIFLNLISAPEGIHCVCKRFPSLKIVTSEIDIEINEEYRVIPGLGEFGDRYFGTDD

SEQ ID NO: 9299 - protein, 223 aa, Ferroplasma acidarmanus
MKIFIDTANIEEIKEANEFGLIDGVTTNPSLIMKASKGGKSFKAIATEILREVNGPVSLEVVAEKAEDMVEQALKLHALGSNAVIKIPMTLQGLKAMKILKEKEIKVNTTLIFNAIQALLAAKNGAAFVSPFVGRLDDIGEDGMAIIDQIKTEYTNYGYKTEVLVASIRNPVHVLRAALMGADAVTIPYDVIKKLAMHPKTDEGLNRFLDDWKKVSPDGSLPL

SEQ ID NO: 9300 - protein, 818 aa, Magnetospirillum magnetotacticum
MKKAKPPVVRLLSDDVASIKEAIGSHLLYTVGKEPINATARDWFMAAAHTVRDRVTEHWMPTLNRYYREDSKRVYYLSMEFLIGRTLVNSLINLGLYDTVRQAISELGQDFDEVAAWEVEAALGNGGLGRLAACLLDSMATIGVPGFGYGIRYDYGMFTQHVDNGWQVESPENWLRYGNPWEFPRPGVIFPVRFGGRVIHFRDVLGHTRSQWVDAEEVMAMAFDVPVPGYGGKVVNNLRLWSAKSTREFDLKYFNAGNYIEAVRDKNESETLSKVLYPSDMTDRGKELRFKQEYFFVAASIQDILARFRKSHSDWNRLPDKVAIQLNDTHPALVVAELMRVLVDEHQIEWSQAWDLVRGCCAYTNHTLLPEALETWSIDLFERVLPRHLEIVFALNHEFLQGVRYRHPGDSELLRRVSLIAEGDERRVRMGHLAVIGSHKVNGVAAIHTGLMKSTIFSDFEHLSPGKITNKTNGVTPRRWLLAANPALAALITSQIGDGWITDLDKLHRLEPLADDPAFRKQFAAVKRGNKERLAVMLSQRLGVEVDVDSLFDVQVKRIHEYKRQLLNVLHVITRYGRIRSNPLIHPVPRTVIIGGKAAPGYHIAKLIIKLVNDVAEVINNDPLVGGKLKLIFIPNYNVSTAELVMPAADLSEQISTAGTEASGTGNMKMSMNGALTIGTWDGANVEICEEVGEENMFLFGLSAQDVARRRVDGYDARAAVKADPDLSWALEMIGTGFFSSDQPDRYQQLVDILTTGGDHYLLSADFPLYMAAQERVDQTYRDPEDWTRKAILNVARMGKFSSDRTVAEYAREIWGAL

SEQ ID NO: 9301 - protein, 393 aa, Campylobacter jejuni subsp. jejuni NCTC 11168
MQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSVYDEFVDKFVKAMSKVSVGNTLKGDFDMGPLVNQAGVDNALAMLQRATAKGAIVECGGKITDTSGYYFPASVLTNVKHEDEIMQKEIFAPILPIAKFDTLDEVIDMANDCEYGLTSSIYTQNLDIAMRASREIKFGETYINRENFEAMQGFHAGFRKSGIGGADGKHGLEEYLATHVVYLQYNTNKQ

SEQ ID NO: 9302 - protein, 212 aa, Zea mays
MQRDGHEGDVSCQGRDDTVMFGPDDDGVKIPTQVETLVKGTAMVAEPEYKASPDLDYLQELLAIQQQGPRAIGFFGTRNMGFMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 9303 - protein, 335 aa, Dechloromonas sp. RCB
MDTLNISLGVVITLVVVALLFDFMNGFHDAANSIATIVSTRVLKPHQAVIWAAAFNFLAYFLFPLKVALTIGKGTIDPSIVDHYIIFGALIGAIVWNIVTWYYGIPSSSSHALVGGLVGAAMAKAGIGGLVSAGVLKIIAFIFVAPFLGFVIGGFLMVIISWICRNMAPRKVDKHFRRFQLLSAAAYSLGHGGNDAQKTVGIIWMLLIAAGISKTTDAIPSWIVLSCYTAMGLGTMFGGWRIVKTMGNRITKLNQARGFCANTGGAITLFLATAFGIPVSTTHTITGAIAGVGSTRGARRVRWGVAGGIVWAWILTIPCSAAMAAAAWYLGTLIL

SEQ ID NO: 9304 - protein, 335 aa, Allium cepa
MEVERVQAIATLTANLGTIPPEFIRSDHERPDLTTYHGPVPELPVIDLANSSQENVVKQISEAAREYGIFQLVNHGIPNEVINELQRVGKEFFQPPQEEKEVYATVPDSGSFEGYGTKLQKDLEGKKAWVDYLFHNVWPEHKINYKFWPRNPPAYRKANEEYTKHLQVVVDKMHSYLSLGLGLESHVLKEAVGGDDLEYLLKINYYPPCPRPNLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDENPPKFKTKKYKDYAYCKINKLPQ

SEQ ID NO: 9305 - protein, 291 aa, Bifidobacterium longum DJO10A
MTQNRAELNRNLAQMLKGGVIMDVTTPEQAKIAQDAGACAVMALERIPADIRAAGGVSRMSDPAMIKGIQEAVSIPVMAKVRIGHIAEARILQAIDIDYIDESEVLSPADDVYHIDKNQFDVPFVCGAKNLGEALRRIAEGAAMIRTKGEPGTGDVIQAVRHMRTMNKQIRELVALRDDEVYEAAKQLAVPYDLAKYVHDNGRLPVVNFAAGGVATPADAALMMELGAEGVFVGSGIFKSGDPAKRAAAIVKATANWQDADLLAKLSENLGEAMVGINEDEIQTIMAARGE

SEQ ID NO: 9306 - protein, 252 aa, Enterobacter cloacae
NDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDF

SEQ ID NO: 9307 - protein, 194 aa, Bacillus subtilis subsp. subtilis str. 168
MILMIDNYDSFTYNLVQYLGELGEELVVKRNDSITIDEIEELSPDFLMISPGPCSPDEAGISLEAIKHFAGKIPIFGVCLGHQSIAQVFGGDVVRAERLMHGKTSDIEHDGKTIFEGLKNPLVATRYHSLIVKPETLPSCFTVTAQTKEGEIMAIRHNDLPIEGVQFHPESIMTSFGKEMLRNFIETYRKEVIA

SEQ ID NO: 9308 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 9309 - protein, 313 aa, Synechococcus sp. WH 8103
WNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLKFRSGDALANPYLAFSAMVMAGLDGIKNQIDPGDGENRDLFELPAEKLAKIATVPPSLNGALEALNADRGFLTAGGVFSDDFIDNWIDFKYEEVQQLRQRPHPHKFAMYYDA

SEQ ID NO: 9310 - protein, 117 aa, Zea mays
MMRSGARGGDAEEEVDRKPVIKPGVHVTLKVQDTAGRTVVFTVRRTQELQALMDAYYASVPDVAYGTGRFLYDGGRLTGAHTPAELGMEEQDEIDFFTELLGGGRHAAAEPGRPVVA

SEQ ID NO: 9311 - protein, 184 aa, Triticum aestivum
  unsure (1)..(184): unsure at all Xaa locations
MGRKFFVGGNWKCNGTVEQVESIVNTLNAGQIASTDVVEVVVSPPYVFLPTVKGKLRPEIQVAAQNCWVKKGGCFHRVKSXLKMLVNLGVPWVILXGHSERRSLMGESSEFVGEKVAYALAQGLKXIACVGETLEQREXGSTMXIVPEQTKXIAGQXKDWTMWLSPTTMWANPVNPVKPRIHAI

SEQ ID NO: 9312 - protein, 278 aa, Saccharomyces cerevisiae
MSQEFVEDYSRTGSSDDEDSGAYDEWIPSFCSRFGHEYFCQVPTEFIEDDFNMTSLSQEVPHYRKALDLILDLEAMSDEEEDEDDVVEEDEVDQEMQSNDGHDEGKRRNKSPVVNKSIIEHAAEQLYGLIHARFILTKPGLQAMAEKFDHKEFGTCPRYYCNGMQLLPCGLSDTVGKHTVRLYCPSCQDLYLPQSSRFLCLEGAFWGTSFPGVFLKHFKELEEYVERKSKESYELKVFGFRINDEAVSGPRMKWLRQYPSTEEDWEEFAKCEFETPAV

SEQ ID NO: 9313 - protein, 505 aa, Pseudomonas aeruginosa UCBPP-PA14
MVLNLDKCIGCHTCSITCKNVWTSREGMEYAWFNNVETKPGIGYPKEWENQEKWKGGWVRAADGSIRPRIGGKFRVLANIFANPDLPEIDDYYEPFDFDYQHLHTAPKAEHQPVARPRSLVSGQRMEKIEWGPNWEEILGTEFAKRRKDKNFDQVQADIYGEYENTFMMYLPRLCEHCLNPACVASCPSGAIYKREEDGIVLIDQDKCRGWRMCISGCPYKKIYFNWKSGKSEKCIFCYPRIEAGQPTVCSETCVGRIRYLGVLLYDADRIHEVASCENERELYEKQLEIFLDPFDPAVIAQARKDGVADSVIEAAQKSPVYKLAMDWKLALPLHPEYRTLPMVWYVPPLSPIQNAAAEGHIGSDGVIPDVESLRIPVQYLANLLTAGDTAPVLLALKRLLAMRAYKRAEHVEGRQDLEVLAKVGLSVEQVEEMYRYLAIANYEDRFVIPSAHREEALSDAFAERSGCGFSFGNGCSGGSNSAVNLFGGKPTNRRDVIQVVQIQE

SEQ ID NO: 9314 - protein, 858 aa, GIBBERELLA ZEAE PH-1
MALLQRFVAPSARGALRQSPAITLMITRKASNASPPKLKDPSLFKQDVCYVNGKWVKAKSGKTFKVNDPSTGDLIGTCPEFDSKDAQLAIRAAADAFPSFRNKTGRERSKLLRAWYEQMTANAEDIAKLITWENGKPMADAKGETTYAANFLEWFSEEAPRVYGDTIPSSVPGNRVWTLKEPVGVCGLITPWNFPAAMITRKIGPALAAGCTVVAKAPAETPFTSLALAELAHRAGIPKGVVNVVTSHENTPELGELLTSDPTIRKVSFTGSTNVGKLLMKQSAGTLKKLSMELGGNAPFIVFDDADADAAVAGAITSKFRSSGQTCVCANRIYVQRGIYDEFVSKFTEKVKSFNVGHGFDQGVTHGPLIHDKAIEKVEAHVKDAEKKGGKVTIGGKRLSDLGSNFYAPTVIRDMTPEMDMASQETFGPVAGLFPFETEEEVVKMANNTEVGLAGYFFSRDLERVHRIAEALEVGMVGVNTGLISDAAAPFGGVKESGFGREGSLYGISEYQITKMITYGVYYGEGSNEYNIHTLNHENVVVITFALQIIERAKCRRFEPCHDQRNFDLYLDPRNAQNRFNHNTLFEMAFSLANAPLRTCLRQLVRSKGPAPLRSIAASPRAFSTSHVLLKKRKISAPANSPNTATAKAAAGSMNKAEYDTAKVPAPDPEDPLDFTAVIAAYAPIDAHFKTQLAGMIHGGRFNPTNLGSLPVTIKDEEGADATFPLRELAQVVPRSGRAISLLVNDKEYIKPIMSAVQSSREFNQQPQRSEDNELELLLKVELERKDDVERRVKEAVQQWKDRIRNARSRHEKTLKDWKKNGTVLPDIVKKAEKELQKVQDKKMKEIDQEEAQTIRQL

SEQ ID NO: 9315 - protein, 164 aa, Aegilops bicornis
VMASSATSVAPFQGLKSTGGLPVSRRSRGSLGSVSNGGRIRCMQVWPIEGIKKFETLSYLPPLSTEALLKQVDYLIRSKWVPCLEFSKVGFVFREHNSSPGYYDSRYWTMWKLPMFGCTDATQVLNEVEEVKKEYPDAYVRVIGFDNLRQVQCVSFIAFRPPGC

SEQ ID NO: 9316 - protein, 557 aa, Xanthomonas campestris pv. campestris str. ATCC 33913
MKAILRASRIGRVILRYRLDALLEGTPAERWLRLAKPFVPRASAEIAAQSRGARLRLALQELGPIFVKFGQILSTRRDLIPPDVAEELTLLQDRVKPFDGEAARLIVERALGLPVSVAFAAFDTTPLASASIAQVHAATLPPDANGLRREVVVKVLRPDIERQIDADIALLHSLATLVERTHPRADKIRPREVVAEIEGTLSAELDLQREGANASVLRRFWEGSDDLYVPEVIWSHTAERALTLERVYGIPSDDVAKLDAAGIDRKALAAKGVRVFYTQVFRDNFFHADAHAGNIWVDSDPERRLNPRFIALDFGIMGQLSQEDQYYLAENFMAIFHKDYRRMAELHVEAGWMPSNVRIDELEAAARSVCEPYFTRPLSEISLAEVLIKLFRVAQRYELTLQPQLILLQKTLLNIEGVGRQLDPKLDIWAVARPVLERILRERYSPRRVLGELRKRLPEIMTHAPDMPRLVHSWLKQQVEGRHQLDIRSSELRALDLSLRKLQTRVVTAITGSGLLVVAAVLYGLHPDGWYLGTVPVWSWISGGAGSAALLIAWLRR

SEQ ID NO: 9317 - protein, 295 aa, Oryza sativa
  unsure (1)..(295): unsure at all Xaa locations
MSQSSPFFSVARAHAGAGGRAAAAALLLRHPVAQLPPRIHGLRYYPSAIVSPAKTLNSHLSLPHATISSFANADNGSSGQADATESEEEQNGESELSEMAKAFHISPRMAMSISVVIAFAALTVPLAMQSVVFHGTNKMKALAYLTLLSGFYMAWNIGANDVANAMGTSVGSGALTLRQAVLTAAVLEFSGAFLMGTHVTSTMQKGILVASVFQGKDSLLFAGLLSSLAAAGTWLQVASSYGWPVSTTHCIVGAMVGFGIVFGGVNXVFWSSLARVSSSWVISPLMGAAAHLMLG

SEQ ID NO: 9318 - protein, 506 aa, Hordeum vulgare subsp. vulgare
MAAPPAIPRRGLFIGGGWREPTLGRRIPVINPATEDTIGDIPAATAEDVELAVAAARSAFLLDGGSRWARASGATRAKYLNAIAAKIKEKISYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVIFDDVADIDKAVEWAMFGCFFNGGQVCSATSRLLLHEKIAERFLDRLVEWAKNIKISDPLEEGCRLGSVISKGQYEKIKKFISTARSEGATILHGGDRPKNLGKGFFIEPTIITGVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 9319 - protein, 157 aa, Zea mays
MAAAATATPAVAPEAGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 9320 - protein, 739 aa, Thermococcus sp. B1001
MRSRKIYMLVVLLLFLGFSEQISTVAAGVSPSYPAGDPQTWVIYQIVIDRFYDGNTSNNDPLKSPGLYDPNKENWKLYWGGDLEGIIAKLPYLYELGVSAIWISPVFDNIDVPINGSNGLEAGYHGYWPKDFKVIEEHFGTWEIFRRLSQEAAKYNITIIIDFVPNHSNPNDAGEYGALYDNGTFVIDYPTDANYATVHPITKSLSYIYNHNGGITNWNDRWEVRYKNLFNLADLNQLNPWVDNYLKESTVSYLEAGIGGIRIDAVKHLEPGWLKTYADYVYARKNVFMFGEWYQGFNDEMYWDMVKFANYTGIGLINIPLQQVLVDVFAYDTKTMWDLESAVNKYTIDFMWQNKLTIFVDSHDVPRFLSLRNDLIRFHQALAFVLTAPGIPIIYYGDEQYLHNDTVNDFGQVGGDPYNRPMMKTWNTSTTAFKLIKTLASLRRYNPALAYGLIATRYVSDDIYIFERKFFDNVVLVAINRNLNSPYVVSNVYTSLPDGSYNDYLGGLLNGVGITVSSGTFSVELPAGSVSVWQYKATPTDPWVGAIDPVMGRAGNIVTVSGEGFGDVPGRVLITNGQDYWTAEVTYWSDKSVEFIVPSGITTQLNENHVEVRIERADGATSNGIAFEYLTNKQIPAIFEVRNTQGTNLETQVGEFLWLTGSVPELSYWSPETIKAVGPMLCPGWPDWFVVASVPADTYIEFKFLKAPLGGTGIWEVGSNHAYLTPSSGIGEVSVEANR

SEQ ID NO: 9321 - protein, 360 aa, GIBBERELLA ZEAE PH-1
MGYPDTFEGFCVDSPKSWNKFEKQTLTPKTWGDRDIDVEIECCGVCGSDVHTVTGGWGDFEGPLCVGHEVVGKAVRVGDKVSEIKVGDRVGVGAQVSSCLKCKLCNNKNENYCPDMVDTYNCKYPDGSVAHGGFASHIRAHEYFTFKIPDALKSEQVAPLLCAGITTYSPLVRAGVGPGKVVAVLGIGGLGHMGVQWAKALGAEVYAMTHSPSKVEDAKKLGAKEVIVTSEEGWADKYKFTFDFILNCADMTHKFDMNAYMGTLNIGGEFHNVGLPDEPLPQFTAGTFAGNAGKITGSHLGNNQEMNAMLKLAAEKNIVAWVETIDISEKGCAEAIERVKENKVRYRFTLTGFEKVFKKD

SEQ ID NO: 9322 - protein, 537 aa, Zea mays
MGAAAAGGHALRAVGDVVSFPATVAAFVEALLQGWAEARAGLLVPLLRAAVLLCTAMSLIVLAEKVFLGAVSSVAKLRRRRPGRVCRCDPDEEAAAASQAYPMVLVQIPMYNEREVYQLSIEAACRLTWPVDRLIVQVLDDSTDSVIKELVKGECERWATEEGINVKYETRKDRAGYKAGNLKEGMRHAYVRACEFVAMFDADFQPPPDFLVRTVPFLVHNPSLALVQTRWKFVNANDCLLTRMQEMSMDYHFKVEQEAGSSLCNFFGYNGTAGVWRTQAIVESGGWEDRTTAEDMDLALRAGLLGWEFVYVGSIKVKSELPSTLKAYRSQQHRWSCGPALLFKKMFWQILAAERVSVWKKWYMVYDFFIARRIVGTFYTFFFFSVLIPLNILLPEAQIPVWELIYIPIAITLLNSVGTPRSIHLVILWVLFENVMALHRFKAILIGFLEADRANEWIVTQKLGNLQKLKSIARLTGSYRFKDRFHFLEVFIGLFLLASACFDYLYRDDYVYLFVLPQSIMYFAIGFQFIGLNVSED

SEQ ID NO: 9323 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAEKAQYVKFHWKPTCGVRCILTHEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 9324 - protein, 223 aa, Glycine max
MGQGTPGGLNRQGLPGDRKPDGGDKKEKKFEPAAPPARVGRKQRKQKGPEAAARLPTVTPLSKCKLRLLKLERIKDYLLMEEEFVANQERLKPQEEKAEEDRSKVDDLRGSPMSVGNLEELIDENHAIVSSSVGPEYYVGILSFVDKDQLEPGCAILMHNKVLSVVGLLQDEVDPMVSVMKVEKAPLESYADIGGLDAQIQEIKGAVELSLTHPELYEDIGIK

SEQ ID NO: 9325 - protein, 524 aa, Agrobacterium tumefaciens str. C58
MSTLGAYFRLARVGWVLVREGVVLALPSDDLPAPAQLLKAALKPFARSKAKRAQRSDRLAVAVERLGPSYVKMGQFLATRPDVVGADFADDLASLQDRMAFFPAAAAKANIEGSLGRSISELYREFGDPIAAASIAQVHPAMVDTPKGPRKVAVKVIRPGVRQRFQNDLEAMYLIADLQQRFVRSARRLRPVEVTRTLEQTTKIEMDLRLEAAALSELAENTRQDPGFRVPEVDWERTGRDVVTMEWIDGVKMSDIEGLKAAGHDLNKLADTLIQSFLRHTLRDGFFHADMHPGNLFVDAKGEIVAVDMGIAGRLGKKERRFLAEILYGFITRDYMRVAEVHFEAGYVPGHHDKASFAQAIRAIGEPIHGQPAETISMGKLLTLLFEVTELFDMETRPELVMLQKTMVVVEGVSRMLNPRFNMWKAADPVVGGWIRDNLGPKRIATDLKDGVKAALKLAEAVPEIAAKTEKLHSELMYMSENGLRFDAQTAEAIGKAEARHTKWGRIALWVIALTLLYIAIRIS

SEQ ID NO: 9326 - protein, 458 aa, Escherichia coli O157:H7 EDL933
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 9327 - protein, 261 aa, Dechloromonas sp. RCB
MMPVGAANIREAIRCGAEIFHALKKLLNKKGHSTAVGDEGGFAPNLGSHAEALQIIMEAIEIAGYVPGQDVLLALDCAASEFYKDGKYKLAGEGLELTSAQFVDYLANLADQFPIVSIEDGMSEADWDGWKLLTDRLGDKVQIVGDDIFVTNTKIFKEGIKKGIGNSILIKINQIGTLSETFAAVEMAKRAGYTAVISHRSGETEDSTIADIAVGLNAGQIKTGSLSRSDRIAKYNQLIRIEEDLGDTASYPGRETFYNLR

SEQ ID NO: 9328 - protein, 577 aa, Shigella flexneri 2a str. 301
MPGMDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 9329 - protein, 153 aa, Glycine max
ISCPDDTTANRAGAGMVVPFTDLKSMVGFHTRKTSHDITCIASNGRRVQCMQVWPPVDKKKVETLSYLPDLDDAQLAKEVQYLLRKGWIPCLEFESQHGFPYREHNRSPRYYDGRYWTMWKLPMFDCTDACQVLKELQEAKTPYPIDLIRIIG

SEQ ID NO: 9330 - protein, 200 aa, Prochlorococcus marinus subsp. marinus str. CCMP1375
MLLVIDNYDSFTFNLVQYFGELASKHSIAKNILVERNDAISISQIKDLDPQAIVLSPGPGNPDQSGVCLEVLSEFAGIKPILGVCLGHQAIAQTFGGKIVRAKELMHGKTSKVFHTGDHLFAGIPVPLVATRYHSLIADRESLPQCLEITAWLKDGTIMGLRHKQFSHLYGVQFHPESVLTEAGHHLLSNFLGLAESSKN

SEQ ID NO: 9331 - protein, 388 aa, Zea mays
  unsure (1)..(388): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFERLFNFXKDRDGYWKWFAGNLASGGAAGASSLVFVXYSLDYARTRLANDAKAANGXCERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 9332 - protein, 295 aa, Actinobacillus pleuropneumoniae
MKVIIPVAGLGTRMLPATKAIPKEMLTIADKPLIQYIVNECVAAGIKEIVLVTHSSKNAIENHFDTSFELETMLEKRVKRQLLEEVRSIVPKDVTLMHVRQGQAKGLGHAVLCGRAVVGNEPFAVVLPDVILADFTANQKTENLAAMIKRFNETQHSQIMVAPVPREDVSSYGVADCDGVEIPAGETAKIVKMVEKPSVEEAPSNLAVVGRYVFSAGIWDLLEKTPVGVGDEIQLTDAIDMLIEQETVEAFHMTGRTFDCGDKLGYMQAFTEYSLRHDKFGNNFKEFIKKLAKTL

SEQ ID NO: 9333 - protein, 225 aa, Triticum aestivum
LVPNSAREKIRGFCHLSTGQEAVAVGIKHALSNEDDIITAYRCHGFALMRGPGPKSARGELLGRRDGIAYGKGGSMHMFAKGFYGGNGIVGAQVPVGAGLAFAHKYNDKKNCTVALYGDGASNQGQVFEAFNMAKLWNLPVLFGCENNKYGMGTSINRSSATTDFYKRGQYIPGLKVNGMDVLAVKAAVAYGKAWAAAGNGPLVYEYVTYRYGGHSMSGSGTTYR

SEQ ID NO: 9334 - protein, 792 aa, Oryza sativa
MEKDHQPVISLRPGGGGGGPRPGRLFSPAFAAAASGSGDLLRSHVGGASKIGDPNFEVRERVRYTRDQLLELREIVDIPEAILIKQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPWSARRGNLSEKDRVLKTVKGILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQQAARLRFMVRDVVDLRSNNWVARREEIKAKTISEIHDEAIKTLGLRPGATGLTRNGRNAPGGPLSPGGFPMGRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASPTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSGQAILSSHAVVIDACNKLLK

SEQ ID NO: 9335 - protein, 335 aa, Shewanella oneidensis MR-1
MSKRTITVIPGDGIGPSIIDSALKILDKAGCDFEYEFADAGLAALEKQGELLPQRTLELIEKNRITLKGPLTTPVGEGFTSINVTLRKKFGLYANVRPVLSFKGTQARYENIDIITVRENTEGMYSGHGQKVSEDGSTAEATSIVTRQGAEQIATFAYELARKESRKKVTIVHKANIMKSTSGLFLKVAREVSLRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKAAPIRKAVSAVIEEGDRTTRDLGGTHGTTDFTQAVLDRL

SEQ ID NO: 9336 - protein, 274 aa, Pelobacter acidigallici
MEQYYMVIDVAKCQDCNNCFMGCMDEHELNEWPGYTASMQRGHRWMNIERRERGTYPRNDINYRPTPCMHCENAPCVAKGNGAVYQREDGIVLIDPEKAKGKKELLDTCPYGVMYWNEEENVAQKCTMCAHLLDDESWAPKMPRCAHNCGSFVYEFLKTTPEAMAKKVEEEGLEVIKPELGTKPRVYYKNLYRFEKNYVTAGILVQGDCFEGAKVVLKSGGKEVASAETNFFGEFKFDALDNGEYTVEIDADGKSYSDTVVIDDKSVDLGFIKL

SEQ ID NO: 9337 - protein, 939 aa, Oryza sativa
  unsure (1)..(939): unsure at all Xaa locations
MAGGGFPVAGGXAPPGDYGGGITFSVVVTCLMAASGGLIFGYDIGISGGVTAMESFLAAFFPGVLRRMAAARRDEYCVYDSHVLTAFTSSLYLAGLAASLAAGRVTRAVGRQAVMLAGGALFFAGAAVNAAAVNIAMLIVGRMLLGFGIGFTNQAAPVYLAETAPAKWRGAFTTGFQLFLGIGNLTANLTNYGAARIPRWGWRLSLGLAAAPASVILVGTLLISDTPSSLLVRGRVEQARAALRRVRGAKADVDAELEGVARAVEAARANEEGAYRRILWRQHRPHLVMAVAVPLLQQLTGVIVIAFFSPVLFQTAGFGSNASLMGAVILGAVNLGSTLVSIATVDRYGRRVLFLTGGLVMIACQVAVAWIMGSQIGRDGESAMARRYSVAVLALTCVFSAAFGWSWGPLTWVIPGEIFPVEIRSAGQGISVAVNLGATFVLTQTFLAMLCSFKYATFLYYAAWVAVMTAFVWAFLPETKGVPLEAMGAVWARHWYWRRFVQPPPAAKDAMLPELSRRLTDKSKSVPALPLASVPRSMLSSAAAASRRFAMPQPASSGSTSRRFDFPDSVLLDTVAHADGCGDDATTARAETSDGLPIEVSFVAADPPTFTRCVVRCSGLTAGEFSKGPPFIIGADGAFLVIRVIFPCRSDRRCFTDFFVYRSGPGTPLLELLRRPYPVKHLSDHLGILSCGEHFLVVNPKWQFHADGQVRCDLHVFSSKTTSWESKVARLPCGVEAYIGDFIPTKVLSVEGRSIAWVDLWNGILLFDSVTSNPEVRLIQLPPLMPINGRYLRGGGLDDTYISVDPNRDITCSNGWFRFIEMGFPLLDGSTGQLNFRWQATMFKRLVRPEECQWEPCGTETDSAELRGVCGDFANLQDGFVGSIFKDAHRAAKLYRCVADLPFSADDSSYTAVAVSAVNATTPLLQAAAPHTGAPLARV

SEQ ID NO: 9338 - protein, 362 aa, Oryza sativa (japonica cultivar-group); identical to SEQ ID NO: 6947

SEQ ID NO: 9339 - protein, 150 aa, Oryza sativa
MAMISAKRIAQLAKKWRRMAALGRKRLTMSSTAMATEEAQGCSTAVAGKGHCAIYTADGARFEVPLAYLGTAVLGELLTMSREEYGFSGDGKITLPCDAMVMEYVLCLLGRNASAEVEKAFLSSMVMPCHYASCVTPSLGACQQVAVCSN

SEQ ID NO: 9340 - protein, 491 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDTFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 9341 - protein, 335 aa, Bacillus subtilis subsp. subtilis str. 168
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 9342 - protein, 604 aa, Glycine max
MWKLVRYAAASNLARSRRFSAAIPGPCIVHKRGADILHDPWFNKDTGFPLTERDRLGLRGLLPPRVISFEQQYDRFMNSFRSLENNTQGQPDKVVSLAKWRILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDRLYLGLRQPRLEGEEYLSIIDEFMEAVHARWPKAIVQFEDFQMKWAFETLKRYQKKFCMFNDDIQGTAGVALAGLLGTVRAQGRPLTDFVNQKIVVVGAGSAGLGVLKMAIQAVAKISGCSELAAKSQFYLIDKDGLVTTERNNLDPAAAPFAKNPRDIEGLTEGASIIEVVKKIRPHVLLGLSGVGGIFNEEVLKAMRESVSTKPAIFAMSNPTMNAECTAIDAFKHAGENMVFASGSPFENVDLGNGIVGHVNQANNMYLFPGIGLGTLLSGAHLITDGMLQAAAECLASYMAEEDILKGILYPSVDSIRDVTAEVGAAVLRAAVEEELAEGNGDVGPKELSHMSKDETVEYVRSNMWYPVYSPLVHEK

SEQ ID NO: 9343 - protein, 214 aa, Schizosaccharomyces pombe
METYEQEYRLLRADIEEKLNDLSKSGENSVIQSCQRLLNEIDEVIGQMEIEITGIPTSERGLVNGRIRSYRSTLEEWRRHLKEEIGKSDRKALFGNRDETSGDYIASDQDYDQRTRLLQGTNRLEQSSQRLLESQRIANETEGIGASILRDLHGQRNQLEHSLEMLGDTSGHLDRSLRTLKTMARRLAMNRFFTTAIIAILVILILLVLYSKFR

SEQ ID NO: 9344 - protein, 290 aa, Oryza sativa
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVAMGLYAMYRNSTPKAVLTKEVEAATATGDDDHSAAGVKEHVVNIAKLSAAVDVVKTREVHPVDVESPPAEAPPEEDDKAAAATAAAVAGAGEKKVAA

SEQ ID NO: 9345 - protein, 389 aa, Methanosarcina barkeri
MTLSMYSDRINALPPYLFATIDEAKDELIARGVDVIDLGVGDPDLPTHPHIVEAMREAVCDPKTHQYPSYAGMPEFRKAAADWCKKYKGVELDPATEVLALIGSKEAVAHIPLAFVNPGDVVLYTDPGYPVYKIGTMFAGGEPYPLPLTAENNFLPDLDSIPENILKKAKLFFFNYPNNPTAATADMQFFEKVVKFCKKYDIIAVHDNAYCQMTYDGYESPSFLAANGAMDIGMELYSHSKTYNMTGWRLGFAVGNKDLIMGLGKVKSNVDSGVFDAIQIAGIAALCSSQTCVEETTKIYQERRDALIEGLKAMGLKVKLPKATFYIWAPVPEGFTSMSFAKLLLEEAGIIATPGVGFGEAGEGYIRFALTKSVERIREAVERMKKLKF

SEQ ID NO: 9346 - protein, 472 aa, Shigella flexneri 2a str. 2457T
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 9347 - protein, 783 aa, Oryza sativa
MDAEAGVGGADQLPWRQHYRNLLLLAYQSFGVVYGDLSTSPLYVYKSTFSGRLRRYQDEQTVFGVLSLIFWTFTLIPLLKYVTIVLSADDNGEGGPFALYSLLCRHAKLSFLPNQQSADEELSTYYRNGFTSRHGSLPWLRRFMEKHKNARTVLLLIVLCGASMMIGDGILTPAISVLSSMSGLKVRATGLHDRSVVLLSCIVLVGLFALQHRGTQKVAFMFAPIVVIWLFCIGGIGLYNIIHWNPRIYQALSPYYIVKFFRTTGKDGWIALGGILLSMTGCEAMFADLGHFTSASVRLAFITIIYPCLILQYMGQAAFLSKNILDMPTGFYDSIPGPIFWPVFVVATLAAVVGSQAVISATFSIVKQCHSLGCFPRVKVVHTSRWIYGQIYIPEINWILMVLCVAVTVAFRDITLIGNAYGVACMTVMFVTTFLMALIMIFVWQKNIIFALSFFLLFGSVEVVYLSSSLMKVTQGGWVPLVLALIFMSVMYIWHYGTRKKYQYDLQNKVSMRYILSLGPSLDVVRVPGIGLIYTELVTGVPNIFTHFTTNLPAFHEVLVFLCVKSVPVPYVSPDERYLVGRIGPRAYRMYRCIVRYGYKDVQRDDDNFENMLVMNIGKFIMMEAEDASSSASYDTANEGRMAVITTSDDYDSPLAVRDSNDLADSMTMRSTKSESLRSLQSSYEQESPNVSRRRRVRFELPEEDDMDQQVKDELLALVEAKHTGVTYVMGHVYIKARKNSSFFKRFAIDVGYSFLRKNCRGPSVTLHIPHISLIEVGMAYQV

SEQ ID NO: 9348 - protein, 506 aa, Oceanobacillus iheyensis HTE831
MRYANPNKQDAIVNFEKRYDNFIGGKYQPPINGNYFENVSPVTGEVFCEIARSTKEDVDAAIDAAHAAKDAWGKTSVAERAVILNKIADRIEENLEKLAVAETWDNGKAVRETLAADIPLAVDHFRYFAGVIRAQEGTLSQIDEDTVAYHFHEPLGVVGQIIPWNFPILMATWKLAPALAAGNCVVLKPAEQTPASIHVLLDLIKDLLPDGVLNVVNGFGVEAGKPLASNSRIAKIAFTGETTTGRLIMQYASENIIPVTLELGGKSPNIFFEDVMDKDDAFVDKAIEGMVMFALNQGEVCTCPSRALVHESIYDRFMEKVIQRVNQIKIGHPLDTDTMMGAQASQEQMEKIKSYLDIGKQEGAEVLTGGNVNALEGELAAGYYVEPTIFKGNNKMRIFQEEIFGPVLSVTTFKDKDEAMEVANDTLYGLGAGIWTRDINTAYRFGRGIEAGRVWTNCYHQYPAHAAFGGYKKSGIGRENHLMMLGHYQQTKNLLISYGEGTAGLF

SEQ ID NO: 9349 - protein, 187 aa, Griffithsia japonica
HEARSLRYASSAIRATASPRSLSTSASTSPQFTVTLFPGHGVGPEISVAVQNIFNAADVPIVWDEHHIDVDNAKPGQDLISADALDSLRRNRFGLKGPMATPIGKGYRSLNLTLRKALGLYANVRPCVSIPGVQTPYDDVDVVTVRENTEGEYSGLEHVVYPGVVESLKVITPERVNARVQVPFSII

SEQ ID NO: 9350 - protein, 291 aa, Oenococcus oeni MCW
MHTLEKRQFMSEKIWFVTGTSSGFGQALVNELIAQKQKIVATARHLDQIVHWQKEYKNVYTTSLDVTNHDDVVRAVNEAIKHFGKIDILVNNAGWGYFGSVEESDESTVREMMDTNFWGAADVTRTVLPFFRKQRSGRIINITSVGGLVSSPAFGFYNASKFALEGLSSALAKEVAPLEIYVTNIEPGPYRTKWAGSSHKAAIETIDDYQKTAHANANNTESISGKQDGSPELAAKAIFKLANMTEPPFHFLTGINAYQRGTALYQETLTEFKNNEADSTHLNYGDEDYWK

SEQ ID NO: 9351 - protein, 267 aa, Zea mays
  unsure (1)..(267): unsure at all Xaa locations
VNPRLVLLPGSPPSASDTWPTRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGGEERVMPVPAAKGRNGGSHAGNNLAMQELMSLPGGATTFAVALRMGSEVYHVLKSIIKTKYGQHACNVGDEGGSAPNGQDNREGLILLMDAIEKAGYTXKIKIGMDVAASEFLTKDGXYDLN

SEQ ID NO: 9352 - protein, 630 aa, Brucella suis 1330
MKVGSNLVDLEICSAISARLKRCGMPQDRIENAFSAAHLHGTGFFEEAVHQPGVTERMVYEAIADYLQLPYTEEILPSRIFVSGDENICFAHIRQVMVIGRDGISYLYIAPGERRIARLREHLKAAPQLRERIRICTPSVLKSILRQRHQRDLVMRAHAMTPQLFSAARVLDTPQAFVIAMAVYAFLGCIVNWPMKTMLALHVAMSLFFFGCVLIRLFAAASGKRLQFTEIAPFKPRDLPVYSILVPLYREKDVVAQLIAALNRLNWPRSKLDIKLVCEKDDYETIAAIRCNTMPSNFKLVLVPPGGSRTKPKALNYALQFARGEIVAVFDAEDRPHPDQLLEAWQAFRRGGSKLACVQAPLIIGNFRRNLLTRMFAFEYAVLFRGLLPWLARRGLVIPLGGTSNHFRRSCLEQVGGWDAYNVTEDADLGMRLARFGYRIDVISRGTIEDAPEEHGVWHRQRTRWIKGWMQTWLVHGRQPMSTWRELGWWRFVVSQIYTLGIIGSALLHPLMLLMLAGLCLRMAFGPLTPQGLWLLALDVINILMAYMSFHMLGAKTMEPTELGGYAYFLAIPIYWVLISLSAWRAVWQLVRQPHLWEKTPHQPNLFYIPLEDASSEFDARNAAPRPIMD

SEQ ID NO: 9353 - protein, 340 aa, Bacillus subtilis subsp. subtilis str. 168
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 9354 - protein, 411 aa, Yersinia pestis CO92
MAELPAKRRFTRIDRLPPYVFNITSELKMAARRRGEDIIDFSMGNPDGPTPPHIVEKMCSVAQREDTHGYSTSRGIPCLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 9355 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVKKKQFFRNFMTITLFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 9356 - protein, 93 aa, Zea mays
KVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 9357 - protein, 88 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFP

SEQ ID NO: 9358 - protein, 370 aa, Lactobacillus plantarum WCFS1
MDNEKPIVDFGAIRDVLGKDFEPVQVLDGQAKVIKPEIVSKYSNEQLVEFFKLMLWERTLHQRSNALTRQGRLGFYAPTEGQEASEMGSNAAMKKTDVLMPAYRDIPQLIQHGLPVYKAFLWSRGHVLGNEYPEDFHAMPPQIIIGAQYVQAAGVALGIKKNGTEDKVAYTYTGDGGTSQGDFYEGMNFAGAFEAPAVFIVQNNGYAISVPRRKQTAAKTLAQKAVAAGIPSVQVDGMDFLAVYEVTKAAREYAAAGNGPVMIETLTYRFGPHTNAGDDPKRYRTKDEEQPWFDNDPLIRYRKYLTDQGVWSEDQENEYVEQVKEDIKAAVKQADEAPKQKMTEFLGNVFEEQPQNIQQQITEFQAKESK

SEQ ID NO: 9359 - protein, 498 aa, Zea mays
  unsure (1)..(498): unsure at all Xaa locations
MDPYKHRPSSAFNAPYWTTNSGAPVWXNNDSSLTVGARGXPSCWEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGXSGVHTYTLVSRAGTVTYVKFHWRPTCGVRSLMDDEAVXLAGANHSHATKDLTDAIAAXGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGFMNFMHRHEEVDYFPSRXYDAARNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 9360 - protein, 452 aa, Yersinia pestis CO92
MQTLPSEKIRMDDVPLNRFHIRIAGLTFGAHFIDGYILGLIGFALIQLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 9361 - protein, 276 aa, Streptomyces coelicolor
MNKVWLITGASSGFGRAIAEAALADGDVVVGAARRPEALDDLVAAHPDQMEALRLDVADTAAAGDAVRDVVARHGRVDVLVNNAGRTHVGALEETGEDELRALFDVHVFGPAALTRAVLPSMRERRSGAIVQMSSMGGQMSFAGFSAYSGTKFALEGMSEGLADEVRDFGIKVVIVEPGSFRTGLFEAGNAGISADSGVYAKVGETRGMIAAGDGSQPGDPARAAAVIRAALAAEHTPLRLPLGDDGVTAVLGHLDRVREEVETWEKQTRATAFDD

SEQ ID NO: 9362 - protein, 339 aa, Synechococcus sp. PCC 7942
MIRIRNRWFRWLAIALASLVASIGIATVGFAATGVTPDQVLSAIEGTFGVNVGQRRNHIKGTCAVGNFVATTEAKTYSRSPLFSGQSIPVVARFSLAGGNPKAPDTAKNPRGLGLQFQLPNNRFLNMALLNTPVFGVASPEGFYENILAIRPDPTTGKPDPEKVKAFREKYPENKAQAAFLASNNPPTSYANTSYFGLHAFKFINQTNQTRLVRWQFVPQDGEKRLTDAELQAAPANFLEQKLIERTQDSPVKWDFWITLGQPGDAEDNPTIAWPSDRQQVKVGTLTLTAASPQPGAACEGINYDPLVLSDGIEPTNDPVLQFRSGVYALSYSKRTRGL

SEQ ID NO: 9363 - protein, 157 aa, Zea mays
MAAAAPAPASVAPSSAPKATGDSRKTVVSVDASELEKHVLAVDDSSVDRAVIARILRGSRYRVTAVESATRALELLALGLLPDVSMIITDYWMPGMTGYELLKCVKESAALRGIPVVIMSSENVPTRITRCLEEGAEGFLLKPVRPADVSRLCSRIR

SEQ ID NO: 9364 - protein, 228 aa, Neurospora crassa
MANILDSEAGTELFKHYETEYQLVQADLVQKLDQISELTGEPRKAALSTAERALEEAGELLDQMNMEKQNVPSSSRTAINKRLRDYRSDVDKYRRKLQTLATDRSALFGGRYTDNPGSSSGDRHFEQRQQLLSGTDRLDRSTQRLKASQALAAETEAIGASTLADLHRQREVIEHTTTILYESEGYVDRSVKTLKGMARRMATNRIITIAIITVLVLLIIAVIVSKFR

SEQ ID NO: 9365 - protein, 307 aa, Zea mays
MAGRLAGRGGRPLLGGSGGGGKRGGRPSMAVVAALLLACAALLLLLALGALSLPGASDGSGGRGAGLSLSRPRSRFRRSAFDSGLETRGEKGEPWTEVLSWEPRAFVYHNFLSKEECDHLISLAKPHMKKSTVVDSATGGSKDSRVRTSSGMFLRRGQDKIIRTIEKRIADYTFIPVEQGEGLQVLHYEVGQKYEPHFDYFHDDYNTKNGGQRIATLLMYLSDVEDGGETVFPSSTTNSSSSPFYNELSECAKGGLSVKPKMGDALLFWSMKPDGSLDPTSLHGGCPVIKGNKWSSTKWMRVHEYKV

SEQ ID NO: 9366 - protein, 215 aa, Zea mays
  unsure (1)..(215): unsure at all Xaa locations
MAAAKIAPSMLSSDFANLASEAERMVRLGADWLHMDIMDGHFVPNLTIGAPVIQSLRKHTKAYLDCHLMVTKPSDYVEPFGKAGASGFTFHIEVARDNWQDLIQSIKSKGMRPGVSLRPGXAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 9367 - protein, 318 aa, Arabidopsis lyrata subsp. petraea
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPVVILGRKVISGSFIGSIKETEEVLAFCKEKGLTSTIETVKIDELNTAFERLSKNDVRYR

SEQ ID NO: 9368 - protein, 94 aa, Podospora anserina
MKVKIKRWNAVATWRWDLPEDDLCGICQNPFDNTCPACKYPGDDCILCEFHTACGYQRNGHCILEWMKQDSAKGQCPMCRQSKLVGCPFLQQFV

SEQ ID NO: 9369 - protein, 352 aa, Pyrenophora teres
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 9370 - protein, 923 aa, Avena sativa
MASKGAGGGGGGHEEPQRPKQQLPRDSRGSLEVFNPSSSSAAVEPPSAFRPAARSASPFIEEATGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALANGSNYCGRVLNYKKDGTAFWNLLTIAPIKDEEGRVLKFIGMQVEVSKYTEGNKDTVVRPNGLPESLIKYDARQKDQARSSVSELLLAIKNPRSLSESTNSTFKRKSQESVGALTGDRPGKRSSESGSRRNSKSGARTSLQKISEVPERGSKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDDTDKGMGDAAAADTHTDMF

SEQ ID NO: 9371 - protein, 331 aa, Photobacterium profundum
MTKIALQQDRPLDAIVLGRAGVDLYAREANTDMADISGFNKFVGGSAANIAVAISKLGGKVGFIGCVADDAFGGYVRGYMTEQGINLDGMMTDNSGSRTSVAFTEMKPNDCTVLIYRNKASDLTLKPEQVDPAYIAQSKMLVVTGTALSESPSREATLIAMEHARRSNTVVVLDVDYRPYSWRTDVDASIYYGIAAGLSDIVIGNREEFDMMETVLAPGNTDDDATADRFLRANTQVVIVKAGELGSKVYCKDGHKFQQGIFRVEVKKPFGSGDSFAGGLIWTLVNGGELEDGVKHGSAAAAINVSGNSCTEAMPTKEVLFDFIETREQDL

SEQ ID NO: 9372 - protein, 325 aa, Glycine max
  unsure (1)..(325): unsure at all Xaa locations
MALEAVVFPQDPFTYGCDKDYLYSLVEHNYGNFQAAEEEKVLLGIINNNIEHNFHANWDSSSTSMLQNVKEQQWDSHSSPEACTVDQSMPAAPFPPPPPSSSVEATVTATSRRKRRRTKSAKNTEEIENQRRTHIAVERNRRKQMNEYLAXVLRSLMPSSYVQRGDQASIIGGAINFVKELEQLLQSMEGQKRTNQAQENVVGLNGSTTTPFAEFFTFPQYTTRGRTMAQEQKQWAVADIEVTMVDSHANLKVLSKKQPGQLMKIVVGLQSLMLSILHLNVSTLDDMVLYSVSVKVGDGCRLNTVDEIAAAVNQLLRTIQEVTFS

SEQ ID NO: 9373 - protein, 373 aa, Oryza sativa
MASSISVMASAGRNRGVGFAKLQGEDFEYFMQTYSIIILGRDSKREKVDLDISGGDLTISRHHAHIFYDFECKRFSLLVLGKCGCTVEGVLHLPGGSPIKLDSQDLLQIGHKKFYFLLPTRSIFGTSSNQHGPSASAAFQPANNGTAADEHNLTASAAAQPAHIGTAAPPPHIGTAQPGQIGIVTLPPAHIQNNAENENIAGIETQEEFMNQNKMPFGELDTCSSHHITIEPTLAPGGQPVNNLAIRPADNNKDQQEVLLKEEEYVLASIGIVISDLCGLKKMIPIEKLHSELVACYSATWPQRQVQMHLAPEAGSSAAGTECKPWLKLMYLLRKYPERFTVMNSSCDEEGRQHRCVCTLYGDGTVCVFLKRT

SEQ ID NO: 9374 - protein, 342 aa, Oryza sativa (indica cultivar-group)
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISLINGGGYSTRQHGDRYAKFQHPDTCWSNQSLLRSLASDVPSLQLHGQGGQGAQVQGEEEGQEV

SEQ ID NO: 9375 - protein, 185 aa, Triticum aestivum
  unsure (1)..(185): unsure at all Xaa locations
MQKTRRGHVVAATSARRRPGDKFARGVREHVTLGPKLYETVRGKLSLGARILQAGGXWQKVFRRWFGRWSKGDEASSNASQCYLSTTAGPIAGMLFVSSETVAFRSDRSLALTSPKGDTVQGCXYKVAVPLRRVKAATPSENQHRPEQKYVQLVTDDGFEFWFMGFVSYQASLQHLEQAIAESHL

SEQ ID NO: 9376 - protein, 82 aa, Glycine max
  unsure (1)..(82): unsure at all Xaa locations
FNMGGVIGGLIPFIXNYHRSEAASVNDGTYIGFMCFMSLGTLLSLAILPACKVVRDDCSRCTNMFYTDVSTECVEVLKLFSN

SEQ ID NO: 9377 - protein, 158 aa, Zea mays
LGTPAVQGLLQAVQEGGAHNVNQCFLEAARYGSTELVRILLQVAQRNSLDIDVDLALGFAAHYGKIETMGCLVEEGNAIGFLGPLMRAAERGCLQVVEWFVNHGCREMELCLALTAATSNSQIAVAAYLLPLVPQHVLAPLSIEIIKAAGERTTGSLQ

SEQ ID NO: 9378 - protein, 434 aa, Streptococcus pneumoniae TIGR4
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 9379 - protein, 278 aa, Cladonia arbuscula
  unsure (1)..(278): unsure at all Xaa locations
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTXLNGDNHSCIFDAKAG

SEQ ID NO: 9380 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9381 - protein, 71 aa, Glycine max
  unsure (1)..(71): unsure at all Xaa locations
PGAGMVVPFTGLKSMVGXPTRKTTIDFTSIVTTGEKFQCMXQVWPPFGKKNFKTFSYLPNLDDPQWAKEVE

SEQ ID NO: 9382 - protein, 212 aa, Nostoc sp. PCC 7120
MTSYATSSAKAEMSELRRLKGLLPPELQSWVTVEGTTEVNPPLIRSEEIGKDQVEIQIDLVKWDALAMDQRNLLFWHEVARIQNDTIPKDGWEMAALAIGLGGAVGELWVQDGLLLVLALALCGVSGWRLYQKNNGEKQIREVLDADEKAIALATRFGYSLPNAYKSLGSALKTLIDTTPSKRQRSRYEARLSALKRSANKAKAKSKTTDED

SEQ ID NO: 9383 - protein, 343 aa, Thanatephorus cucumeris
MTVKIGINGFGRIGRIVLRNAIEHGEVDVVAVNDPFIDLDYMVYMFKYDSTHGRFKGEVKVDKEKKQLVINGKNIDVHSERNPGDINWDASGAEYVVESTGVFTTIEKASEHFKKSPSLKKVVISAPSADAPMHVVGVNLDAYDPKGPKISNASCTTNCLAPLAKIIHDEFGIVEGLMTTVHATTATQKTVDGPSAKDWRGGRGAAANIIPSSTGAAKAVGKVIPSLNGKLTGLAFRVPTADVSVVDLVVRLEKSATYDEIKATIKKASEGEYKGIMGYTEDDVVSTDFVGDEHSSIFDAKAGISLNKNFVKLVSWYDNEWGYSRRVVDLIAYVAKKDKEAGC

SEQ ID NO: 9384 - protein, 240 aa, Pseudomonas syringae pv. syringae B728a
MHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 9385 - protein, 511 aa, Thermus thermophilus
MKVRAHMSMLFHLDKCIGCHTCSIACKNLWTDRKGAEYMWWNNVETRPGAGYPTGWEDQERFRGGWEYKDGHLDLRLHSRTQGLFRLFFNPALPSLDDYYEPFTFRYADLFTAPEGEDQPTAVPVSMITGEPMTPEAGPNWDDDLSGSPLYAKNDPNLKALAPEVRAQLEEIEGVVFQYLPRICNHCLNPACVAACPSGAIYKRAEDGVVLVNENKCKAWRMCVAACPYKKVYYNWATGKSEKCILCFPRLETGQAPACAHSCVGRIRYMGVLLYDADRIPEAAMVPDEELVESQLSLILDPFDPEVIAAAKAEGIDEGWIQAAQKSPIYKFVKTWGLALPLHPEYRTLAMMFYVPPLSPVVATVEKALRAGRGGEGLVRLDIPETDLDFEVYAALEKARMPVKYLANLFAAGNEALIVPILKKMLAVRILKRQESLEGRPTEKALKVLADAGLTLEEAEAIYRLTTLPTLEERFVLPPYHREMAAEVWKDPLAHKGEAGLGYIQPPLRGE

SEQ ID NO: 9386 - protein, 120 aa, Triticum aestivum
ESQRITHIAVERNRRRQMNEYLAVLRSLMPPSHAHRGDQASIVGGAINYVRELEQLLQSLEVQKSLKQSRGRRPAGGGASCSPPFAGFFSFPQYSTAPSTTSSSGGEKCCGTTPRPRTSR

SEQ ID NO: 9387 - protein, 540 aa, Candida tropicalis
MSSSPSFAQEVLATTSPYIEYFLDNYTRWYYFIPLVLLSLNFISLLHTKYLERRFHAKPLGNVVLDPTFGIATPLILIYLKSKGTVMKFAWSFWNNKYIVKDPKYKTTGLRIVGLPLIETIDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDDSVGLTPTTKDFEGRGDFADAFNYSQTYQAYRFLLQQMYWILNGAEFRKSIAIVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINEALRLYPSVPHNFRVATRNTTLPRGGGKDGCSPIVVKKGQVVMYTVIGTHRDPSIYGADADVFRPERWFEPETRKLGWAYVPFNGGPRICLGQQFALTEASYVTVRLLQEFGNLSSDPNAEYPPKLQNTLTLSLFDGADVRMF

SEQ ID NO: 9388 - protein, 251 aa, Listeria monocytogenes EGD-e
MRKPIIAGNWKMNKTAAKAGQFAEDVKNNVPSSDAVESVVAAPALFLQELVRLTEGTDLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 9389 - protein, 194 aa, Xylella fastidiosa 9a5c
MLLMLDNYDSFTYNLVQYLQTLGAEVMVIRNDAMTVEQIAALKPERIVISPGPCTPNEAGVSLKLIEQLGSSTPILGICLGHQSIGQAYGGDVVRATNIMHGKTSAIYHNGKGVFVGLPNGYDATRYHSLVVDKTTLPDVLEVTAWTEDQDGTIEEIMGLRHRKYFVEGVQFHPESILTEHGHALLKNFLERPL

SEQ ID NO: 9390 - protein, 429 aa, Pyrobaculum aerophilum str. IM2
MPDGLAVWRVLRGAGVKLVKFVVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 9391 - protein, 557 aa, Triticum aestivum
MDSARSWFQKFQPRDKSKSPAVPASHGKDPGKPPVDDAPSSATKQKVAAAKQYIENHYKTQMKSLQDRKERRWMLERKLQDAEVPAEEQNNILKHLEKKETEYMRLQRHKMGVEDFELLTIIGRGAFGEVRLCREKTSKSVYAMKKLKKSEMLRRGQVEHVKAERNLLAEVDSAYIVKLYYSFQDDEFLYLIMEYLPGGDMMTLLMRKDTLTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGGFLNMLPHKEGQPSSHSSAPPEQYQPRRK

SEQ ID NO: 9392 - protein, 500 aa, Escherichia coli
MMTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 9393 - protein, 356 aa, Escherichia coli CFT073
MSTVTITDLARENVRNLTPYQSARRLGGNGDVWLNANEYPTAVEFQLTQQTLNRYPECQPKVVIENYAQYAGVKPEQVLVSRGADEGIELLIRAFCEPGKDAILYCPPTYGMYSVSAETIGVECRTVPTLDNWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIVAMRERVAQIITEREYLIAALKEIPCVEQVFDSETNYILARFKASSAVFKSLWDQGIILRDQNKQPSLSGCLRITVGTREESQCVIDALRAEQV

SEQ ID NO: 9394 - protein, 110 aa, Glycine max
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERQKYGFKKR

SEQ ID NO: 9395 - protein, 41 aa, Brassica oleracea
PISTFRSPKFLCLASSSPALSSKEVESLKKPFTPPKEVHVQ

SEQ ID NO: 9396 - protein, 340 aa, Zea mays
MRPSLMRSTSQFFRRRSYSSASGQPERKVAILGAAGGIGQPLSLLMKLNPLVSSLSLYDIAGTPGVAADVSHINSPALVKGFMGDEQLGEALEGSDVVIIPAGVPRKPGMTRDDLFNINAGIVKNLSTAIAKYCPNALVNMISNPVNSTVPIAAEVFKKAGTYDEKKLFGVTTLDVVRAKTFYAGKANLPVTDVNVPVVGGHAGITILPLFSQATPATNALSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANDN

SEQ ID NO: 9397 - protein, 307 aa, Agrobacterium tumefaciens
SFDKIPRIASHSRDGVIELMPTSDGTLYGFKYVNGHPKNTKSGRQTVTAFGVLSDVDSGYPLLLSEMTILTALRTAATSAIAAKYLARKDARTMALIGNGAQSEFQALAFKALLRIDRIRLYDIDPEATARCSRNLHRFGFQIEACTSAEQAVEGADIITTATADKHNATILSDNMIGPGVHINGVGGDCPGKTEMHRDILLRSDIFVEFPPQTRIEGEIQQLAPDHPVTELWRVMTGQDVGRKSEKQITLFDSVGFAIEDFSALRYVRDRVEGSSHSSPLDLLADPDEPRDLFGMLLRRQALLAAS

SEQ ID NO: 9398 - protein, 196 aa, Mitthyridium sp. Tan 1982
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFVKL

SEQ ID NO: 9399 - protein, 396 aa, Gossypium hirsutum
  unsure (1)..(396): unsure at all Xaa locations
MSLSLQSSPSSFLSSSLPKLRLGFANGCPSSSLLFKFNASFPAIRASSGFSSSLDTGLRTELDAVSTFSEIVPDTVIFDDFEKFPPTAATVSSSLLLGILSLPDTIFRNAVDLALADSTCSRLDNPELRLACFFNKALVNVGGDLAKLVPGRVSTEVDARLAYDTHGIIRRVHDLLKLYNEIDVPPERLLFKIPXTWQGIEASRLLESEGIQTHLTFVYSFAQAAAAAQAGASVIQIFVGRVRDWARNHSGDPEIEAAIQRGEDPGLGLVTKAYNYIHKYGHKXKAYGLQQFETKQDLFSXLGVDYIIAPLKILQSLKESITAPDEKYSYIRRLSPQSAANHDFTAEELTKWDQLSLASAMGPASMQLLAAGLEGYVNQANRVEELLDKIWPPPNV

SEQ ID NO: 9400 - protein, 152 aa, Zea mays
  unsure (1)..(152): unsure at all Xaa locations
MISTKRISQMVKKWQRMAVLGRKRLSWRVEREVEDRSCASVASKDHCMMYSLDGRRFEVPLAYLGTLVFXELLWMSYEEFGFVSHGRITLPCDAAAVEYAMCLLRKGSSADVEKAFLSTMAVSCHYASCIAIAPFVGVSHQAVICSSWLTVK

SEQ ID NO: 9401 - protein, 209 aa, Desulfovibrio vulgaris subsp. vulgaris (strain Hildenborough)
MFLLIDNYDSFTFNLVQAFYGLGLAPVVVRNDDPALVACATRPDLDMVCISPGPSHPRNAGGCLAFLDVLPRTVPVLGVCLGHQVLGLYAGATVEVGPRIMHGKTSDITHDGAGLFAGLPQPMTVGRYHSLIVRAEEKPDLLEVTARTPEGEVMAMRYRDRPWVGVQFHPESVLTPDGVRLLGNFPAMTGGSCPRMTPHGATVRQEVTA

SEQ ID NO: 9402 - protein, 330 aa, Kluyveromyces marxianus
VRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 9403 - protein, 413 aa, Podospora anserina
MGDLQGRKVFKVFNQDFIVDERYTVTKELGQGAYGIVCAAVNNQTNEGVAIKKVTNVFSKKILAKRALREIKLLQHFRGHRNITCLYDMDIPRPDSFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPFMAKKSFPSLFPNANPDALDLLDRMLAFDPSRRISVEEALEHPYLAIWHDASDEPDCPTTFNFDFEVIDDVNEMRKMILSEVVNFRAQVRTVPGQAGSAGNIQQAPSNVPIPAGGPGQQWTAEDPRPMEYGNQMQGLEAELGGR

SEQ ID NO: 9404 - protein, 151 aa, Zea mays
VRPFPLFFLQPSKRPAKQGTQIESSPCHARKAPAAHDGNGNGGAAAAAAPKGCVTVRVGLEGEEQRRFAVPLGHLKHPLFGALLEEAEREYGFRHQGALAIPCRVDRFVQLERLIGGDHHGACAHHLVALDAGALHHHHLHLPRFVGCFRA

SEQ ID NO: 9405 - protein, 298 aa, Arabidopsis thaliana
MARRGLLISFFAIFSVLLQSSTSLISSSSVFVNPSKVKQVSSKPRAFVYEGFLTELECDHMVSLAKASLKRSAVADNDSGESKFSEVRTSSGTFISKGKDPIVSGIEDKISTWTFLPKENGEDIQVLRYEHGQKYDAHFDYFHDKVNIVRGGHRMATILMYLSNVTKGGETVFPDAEIPSRRVLSENEEDLSDCAKRGIAVKPRKGDALLFFNLHPDAIPDPLSLHGGCPVIEGEKWSATKWIHVDSFDRIVTPSGNCTDMNESCERWAVLGECTKNPEYMVGTTELPGYCRRSCKAC

SEQ ID NO: 9406 - protein, 467 aa, Escherichia coli K12
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 9407 - protein, 488 aa, Porphyra yezoensis
MSQSVESRTRIKSERYESGVIPYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 9408 - protein, 401 aa, Zea mays
NSARGIDRTIYQKFRIYLSAPGSPLRKLEQDGKASPGCAGDASAACTTCRLTLGITDGLLPNGNFERSPLPSQLRGTRVVGASAIPSWQTSGFVEYISSGQKQGDMVLVVPEGAYAVRLGNEASIRQRLRGAARGARYSLTFSAARTCAQAEQLNVSASGQSGLLAMQTMYSSNGWDSYAWAWVANADEVDIVIHNPGVTEDPACGPLIDSVAIKTLNPPRRTNKNLVKNGDFEEGPYIIPGTKWGVLIPSRVVEDHSPLPGWMVESLKAIKYIDGESFAVPRGRRAVELLAGRESAIAQVIRTVPGRQYVLSFTIGDASNACRGSLMVEAYAGRESTKVAYESAGKGGVKRAVLPFRAASARTRLVFFSSFYSTRSDDLSSLCGPVLDDVVVVSVRTKRG

SEQ ID NO: 9409 - protein, 424 aa, Yersinia pestis CO92
MDHCNTSDLLSLEQALTKMLSQATPLPATEVIPLSEAAGRITASAITSPIAVPPFANSAMDGYAVRWHELSDEIPLPVAGVAFAGAPFKDVWPEKTCIRIMTGAPLPKGADAVVMQEHAVVSEQGVIFNSNIRIGQNIRLAGEDIQQGASVFPAGVKLGAAQLPLLASLGIAEIAVYRALKVAIFSTGDELQPIGHPLAEGQIYDTNRFAVRLMLQQLGCQIIDLGVIRDDQHALRAAFQQADTAADLVISSGGVSVGEADYTKQILDELGDIGFWKLAIKPGKPFAFGKLSNAWFCGLPGNPVSAALTFYQLVQPLLAKLSGHTEWHPPLRLKAKATTPLKKTPGRLDFQRGVFSSNADGQLEVRTTGHQGSHIFSSFSQGNCFIVLERERGSVAVGESVEIELFNELLGGNRPFAIHHPVGG

SEQ ID NO: 9410 - protein, 298 aa, Triticum aestivum
MLMRRRRQRPVLPRLLLATLLIASAVAFLPRAAGDAAEAGDEGRVGEAVAAVERADAAAAALGAAEAGGEAAQGNATTKEHSLADMIDRALEKEFPDSEGDQGGGETDPGSFNNTVAEKQGVLETVATRVTKKNETKDNNSFPFKEVFLDRSEQEDVPTLIDRKDNVFIISNRKSKYPVLQLDLTLISDLVVVIVSATCGGIAFACLGQPVITGYLLAGSIIGPGGFSFVNELVQVETVAQFGVIFLLFALGLEFSTAKLRAVRAVAVLGGLPLFLLFMFLCGISATLCGGKTKGGCF

SEQ ID NO: 9411 - protein, 335 aa, Pichia angusta
MTANVGINGFGRIGRLVLRIALSRDDINVIAINDPFIAPDYAAYMFKYDSTHGKFKGTVTHEGKYLVINGKKIEVFQERDPANIPWGKEGVDYVLDSTGVFTTIEGAQKHIDAGAKKVIITAPSKDAPMFVVGVNHEEYTPDIKILSNASCTTNCLAPLAKVINDIFGIEEGLMTTVHSITATQKTVDGPSHKDWRGGRTASGNIIPSSTGAAKAVGKVLPALAGKLTGMSMRVPTTDVSVVDLTVNLKKPTTYEDICATMKKAAEGPLAGILGYTDEAVVSSDFLTDSRSSVFDAKAGILLTPTFVKLVSWYDNEYGYSTRVVDLLQHVAKVSA

SEQ ID NO: 9412 - protein, 306 aa, Arabidopsis thaliana
MSVMQQNLSVEPKSKKRKIDSEINNSSSSTNCDHFFVRYGICCNCRSNVERHRGRSFDYLVDGLQLSDIAVTVTKRVTTQITCFNDKKLHLVLDLDHTLLHTVMISNLTKEETYLIEEEDSREDLRRLNGGYSSEFLIKLRPFVHEFLKEANKMFSMYVYTMGDRDYAMNVLNLIDPEKVYFGDRVITRNESPYIKTLDLVLADECGVVIVDDTPHVWPDHKRNLLEITKYNYFSDKTRHDVKYTKSYAEEKRDESRNDGSLANVLKVIKQVYEGFFSGGVEKDLDIDSKDVRLLLHDARRPKFYC

SEQ ID NO: 9413 - protein, 238 aa, Oryza sativa
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 9414 - protein, 518 aa, Lotus japonicus
MASLSCSATDLAPLLTATTNATATAAATYLCNQLDTISRKLSDTTYAVDNTYLLFSAYLVFAMQLGFAMLCAGSVRAKNTMNIMLTNVLDAAAGGLSYYLFGFAFAFGAPSNGFIGRHFFGLKHYPSPTYDYSFFLYQWAFAIAAAGITSGSIAERTQFVAYLIYSSFLTGFVYPVVSHWLWSSDGWASPTRTTGSLLFGSGAIDFAGSGVVHMVGGIAGLWGAFIEGPRIGRFDRTGRSVALRGHSASLVVLGSFLLWFGWYGFNPGSFLTIAKAYGNNGENGNYYGQWSAIGRTAVTTTLAGCTAALTTLFSKRLLEGHWKVLDVCNGLLGGFAAITSGCSVVEPWPAIVCGFVAAWVLIGLNLVAAKMKYDDPLEAAQLHGGCGAWGVLFTGLFAKGEYVAEVYGSAGRPYGLLMGGGGKLLAAQVIEILVVCGWVTATMGPLFYGLHKTKLLRISEDDETAGMDLTRHGGFAYAYHDDDDVSTKRGVMMSRIGPGSSSPSTMNTPAASAAANDC

SEQ ID NO: 9415 - protein, 439 aa, Brassica oleracea
MGADTPQLPVIYLSDQTLKPGSEKWVEVRSDVRKALEDYGAFEVSYDRVSEELKKSVLDAMIELFELPVEAKQRNVSPKPYTGYSTHNGLSESLGIQDSNVLEKVNEFTQLLRPDCEGNKTMSETIQKFSEKLAELDVMVRRMVIESFGIENYFDEHLKSTNYRLRLMKYVAPPDVDANVAVSTKDSVDGANTNTTANADAGDIANGIAKVHIDDDANAKGDVCTGVGTNHNGDDVNTGDCANVKSNVDVGTNVSAKSSVGADVNIGTIADVKANTGTRTSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRPRSTLHAYCAVSGA

SEQ ID NO: 9416 - protein, 140 aa, Magnetospirillum magnetotacticum
MLYPTYLRRSDPFALMRSMMRDLDRGFWPPARAAFPAVNVWQGPEAVGVTAELPGIEPGDIEISVKDNVLTLSGERKAPEVLDGARWHRNERSFGRFSRTIRLPFAASDDKVEARMTNGVLRIVISRPEEEKPKKIEGIL

SEQ ID NO: 9417 - protein, 777 aa, Phragmites australis
MSLEVEKPGGTESTNRLSLKRHDSLFGDAEKVSGAKHHGSEVSWSRTLHLAFQSVGIIYGDIGTSPLYVYSSTFPSGIKNNDDLLGVLSLIIYTLIIIPMLKYVFIVLYANDNGDGGTFALYSLISRYAKIRLIPNQQAEDAMVSNYSIEAPSSQLRRAQWVKQKIESSKAAKIALFTLTILGTAMVMGDGTLTPAISVLSAVSGIREKAPSLTQTQVVWISVAILFMLFSVQRFGTDKVGYTFAPVISVWFLLIAGIGLYNLVVHDIGVLRAFNPMYIVHYFKRNGKDGWVSLGGVILCVTGTEGMFADLGHFNVRAVQISFTGILFPSVALCYIGQAAYLRKFPENVGDTFYRSIPAPLFWPTFIVAICAAIIASQAMLSGAFAILSKALSLGCLPRVRVIHTSKKYEGQVYIPEVNFMMGLASIIVTIAFRTTTSIGNAYGICVVTTFSVTTHLMTLVMLLIWKKHIVFILLFYVVFGFTELIYLSSILSKFIEGGYLPFCFAVVLMTLMATWHYVHVKRYWYELDHVVPTNEMTTLLEKNDVRRIPGVGLLYTELIQGIPPVFPRLIKKIPSVHSIFVFMSIKHLPIPHVVPAERFLFRQVGPREQRMFRCVARYGYSDRLEESKEFAAFLADRLKMFIQEESAFAQNEAENDESSPSTEVPEAQTRPRRSTHSVVHSEEAIHPRVSSQSGRITFPANHSVEEEKQLIDREVERGVVYLMGEANVSAGPKSSILKKIVVNYIYTFLRKNLNEGHNALSIPKDQLLKVGITYEI

SEQ ID NO: 9418 - protein, 314 aa, Geobacter metallireducens
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 9419 - protein, 426 aa, Sirodotia suecica
EASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSMEGVNRAQAAAGEIKGHYLNVTAGTMEEMYERAEFAKELGSIICMIDLVIGYTAIQSMALWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 9420 - protein, 425 aa, Shigella flexneri 2a str. 301
MIDRLPGVSTLTLQPKTPFLQALDACFRVAYSLDNLPYHQRCPVFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLASEQSAAICEELANFDYLYLSGISLAILSPTSREKLLSLLRECRAKGGKVIFDNNYRPRLWASKEETQQVYQQMLECTDIAFLTLDDEDALWGQQPVEDVIARTHNAGVKEVVVKRGADSCLVSIAGEALVDVPAVKLPKEKVIDTTAAGDSFSAGYLAVRLTGGSAENAAKRGHLTASTVIQYRGAIIPREAMPA

SEQ ID NO: 9421 - protein, 302 aa, Mycobacterium tuberculosis CDC1551
MMARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 9422 - protein, 254 aa, Zea mays
  unsure (1)..(254): unsure at all Xaa locations
SPPPPRVCIFGGKAFATYVQAKRIVKFITDVASTINHDPEIGDLLKVIFVPDYNVSVAELLIPASELSQHISTAGMEASGTSNMKFSMNGCVLIGTLDGANVEIREEVGEENFFLFGAKADQIVNLRKERAEGKFVPDPTFEEVKKFVGSGVFGSNSYDELIGSLEGNEXFGRADXFLVGKDFPSYIECQEKVDXAYRDQKRWTRMXIMNTAGSFKFXXDRTIHEFPXDIWXINQWNFEPLDKSTLRTFSHVSM

SEQ ID NO: 9423 - protein, 702 aa, Oryza sativa (japonica cultivar-group)
MASTTTKNALLLLLLLLLLFPLLHSSLADVAAAAPSSASAAEVDALMELKAALDPSGRLLPSWARGGDPCGRGDYFEGVSCDARGRVAAVSLQGKGLAGAISPAVAMLPGLTGLYLHYNELAGAIPRQLGDLPMLAELYLGVNNLSGTIPVELGRLPALQVLQLGYNQLSGSIPTQLGQLKKLTVLALQSNQLTGAIPASLGDLPELARLDLSSNRLFGSIPSKLAAIPKLATLDLRNNTLSGSVPSGLKKLNEGFHFDNNSELCGAHFDSLKPCANGDEDDNEEGSKMARKPESTNVKPLQAPQTMNVNRDCDNGGCSRSSSSSTTLSSGAILAGTIIIIGGAAACGISVISWRRRQKQKVGGGGTVESLEGRASSSNASSSLINVEYSSGWDTSSEGSQQGLRLSPEWSPSVRYNMEEVECATQYFAGANLLGRSGFAATYRGAMRDGAAVAVKSIGKSSCKAEEADFLRGLRAITSLRHDNLVALRGFCRSRARGECFLVYEFMANGSLSRYLDVKDGDVVLDWATRVSIIKGIAKGIEYLHSSKANKAALVHQNICADKILMDHLFVPHLSGAGEHKLLADDVVFSTLKDSAAMGYLAPEYTTTGRFTDRSDVYAFGVVVFQVLTGRKAVSSELRLLGGGGGAEYSGKLDDLVDPRLGGRFSRPEAAKLAGIALLCTSESPAQRPAMAAVLQQLGATQ

SEQ ID NO: 9424 - protein, 353 aa, Triticum aestivum
  unsure (1)..(353): unsure at all Xaa locations
MASDHERLRALTAFDDTKAGVKGLVDAGVTAVPSIFHHPPECLPAADAELHHFTIPVIDLASDSRVALVAQVKAAAQAVGFFQVVNHDVPDDLLAEMLVSVRRFHESPVETKRAYYSRDHRRTVQSNSNFYLFQSPAASWRDTMFLQXASLAPSEEIPEACRAVAPEYARQVQRLGRALFELLSEALGLDLSYLEEETMCLDRVNISGHYYPACPEPHLTLGTSRHSDASLLTVLLQDTVGGLQVLLDDGKWADVPAVPGALVVNVGDYLQLMSNNRFKSVEHRVVANSVESRVSVACFIVPNQSSARVLAPIVTGDGSVARYRSTTVEDMFRYYRNRTKALNGTSALQHFTI

SEQ ID NO: 9425 - protein, 158 aa, Xanthomonas campestris pv. campestris str. ATCC 33913
MNIVRYPQWPTHALQNEIKQVFDRFFEQSGDTDESAVVTAQWVPRVDIKEEANQFVLYADLPGIDPSQIEVQMDKGILSIKGERKSESSSETERFSRIERRYGSFHRRFALPDSADADGITADGRNGVLEIRIPKRPAATPRRIQVGGGQDGGGTTVQ

SEQ ID NO: 9426 - protein, 362 aa, Nostoc punctiforme
MTQNYRITLLPGDGIGPEIMAVAVDVLKVVGKQFDLKFEFQEALIGGAAIDATGEPLPSATLETCRNSDAVLLAAIGGYKWDSLPSNLRPEAGLLGLRAGLGLFANLRPAKILPQLIDASTLKREVVEGVDIMVVRELTGGIYFGKPKGIFATETGEKRGVNTMVYTESEIERIGRVAFEAARKRGGKLCSVDKANVLEVSQLWRDRITQLSQEYPDIELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPKAADRIEQAVFQVLEQGDRTGDIISPGKNLLGCRAMGDSLIKALEQK

SEQ ID NO: 9427 - protein, 731 aa, Oryza sativa (japonica cultivar-group)
MDTASFVTSLLTSFVIFVVLVLVFTWLSSRPGNAPVYYPSVLLRGLDPWEGRGRGTRSPVGWLRQAISASEGDVVAAGGVDAAVYLVFLSSVLSILVFSGIVLLPVLLPVAATDDNLNLERAIGLKNGKTPQNFTELEKLALGNVQEHSRRLWAFLLSVYWVSFVTYFVLWKSYKHVSNMRAAARSTPDVKPEEFAVLVRDVPKPPPDQTIKDSVDSYFRALHPDTFYRSMVVTDHTKADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPKIKTVLQAYLPQLALIVFLALLPSLLMFLSKLEGIPSQGHTVRAAAGKYFYFIVFNVFLGVTISSTLFSALTTIINNPPGIVNMLASSLPGSATFFLTFVALKFFVGYGLELSRLVPLIIFHLKRKYLCKTEDEVRAAWAPGDLGYNTRVPNDMLIVTIVLCYSVIAPLIIPFGVAYFALGWIIVKNQVLRVYVPSYESNGRMWPHMHTRIIAALLIYQITMVGVILLKKFLYSPVLVPLIPISFIFAYICHMRFYPAFAKTPLEVVQHNVKDTPNMDAVYTSYIPACLKPEKLEDVDIFEDAQLHTTSRAPSI

SEQ ID NO: 9428 - protein, 548 aa, Oryza sativa (japonica cultivar-group)
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGSTVPQADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 9429 - protein, 463 aa, Pseudomonas syringae pv. syringae B728a
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWVFTLVITLVLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPAVSKRTSKGGTPHWAVIMSTAAAFLTVFANYIAPAAVFDFLLASSGAIALLVYLVIAVSQLRMRQKRIAAGEAIDFKMWLFPWLTWAVIAFIVAVLTIMLLQEEHRLEIIATGVLSLLVIGAGMIVSRRRKDGRVGAAALG

SEQ ID NO: 9430 - protein, 357 aa, Triticum aestivum
  unsure (1)..(357): unsure at all Xaa locations
LKPPLPFLPAPLPPPPLTIPPALLPSLSPRARPAIAGRGDLVANPAAVLVHGVPPVEGVSLAGGASVLKAPGGAPATVSAAAGGLIGDAGFGGAPGAVGFPRNLAARRRVPGVLGGPGVDAGGAGFALAVRTPRADGPRRPDGDRDSIADRHPSADVLLVGADLKVDVIDYASVSLIAEPCRSAHLRPKEIAXRADALLSYDPNVQEALGPVLDEDRTNILSIWDEADIVNVNEVQLEFLTGINSVEDDVAMKLWRPTFKLMLVTLGDQGCKYYTNDSRSTVPSYKVQQVDTTGAGDAFIGSLLRKIVQDPSALQDKTKLEGAIKFANACGAITATKKGAIPSLPNEVVEMLLLEKV

SEQ ID NO: 9431 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYGRFFSQPLLLGKNGVEERKSIGTLSA

SEQ ID NO: 9432 - protein, 850 aa, Brassica oleracea
MRIFRKTLVSFPLFIFLFLYESSTAQDTIRRGGFLRDGSTHKPLVSPQKTFELGFFSPGSSPGRYLGIWYGNIEDKAVVWVANRENPISDRSGVLTISNDGNLVLLNGQNITVWSSNITSTNNDNNRVGSILDTGNFELIEVSSERVIWESFNHPTDTFLPHMRVRVNPQTGDNLAFVSWRSENDPSPGNFSLGVDPSGAPEIVLWGRNNTRRWRSGQWNSAIFTGIPNMALLTNYLYGFKLSSPPDETGSVYFTYVPSDPSVLLRFKVLHNGTEEELRWNETSKRWTKFQAAPESECDKYNRCGSFGICDMRGDNGICSCVKGYEPVSLGNWSRGCRRRTPLRCERNVSNVGEDEFLTLKSVKLPDFETPEHSLADPEDCKDRCLKNCSCTAFTFVNGIGCMIWNQDLVDLQQFEAGGSSLHVRLADSEIGESKKTKIVVIVAVLVGVLLLGIFALLLWRFKRKKDVSGTYCGHDADTSVVVVDMTKAKDTTTAFTGSVDIMIEGKAVNTSELPVFCLKVIVKATNDFSRENELGRGGFGPVYKGVLEDGQEIAVKRLSGKSGQGVDEFKNEIILIAKLQHRNLVRLLGCCFEGEEKMLVYEYMPNKSLDFFIFDEMKQELVDWKLRFAIIEGIARGLLYLHRDSRLRIIHRDLKVSNVLLDGEMNPKISDFGMARIFGGNQNEANTVRVVGTYGYMSPEYAMEGLFSVKSDVYSFGVLLLEIISGKRNTSLRASEHGSLIGYAWFLYTHGRSEELVDPKIRATCNKREALRCIHVAMLCVQDSAAERPNMAAVLLMLESDTATLPVPRQPTFTTSTRRNSMDVNFALDSSQQYIVSSNEITSTVVLGR

SEQ ID NO: 9433 - protein, 185 aa, Hordeum vulgare
KYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNSYYDMNARIG

SEQ ID NO: 9434 - protein, 221 aa, Triticum aestivum
  unsure (1)..(221): unsure at all Xaa locations
NLLLYLIASHVLGALWYLLSVDRQTACWKMNCRNGSDCNIRYLDCDTPNQTWASTTDLFSRCNASNDTITFDYGMFQPALSNQAPAQGFLRKFFYSLWWGLQNLSCYGQTLSVSTYXXETLYCIFLAVLGLVLFAHLIXGNVQTYLQSITVRVEEXAIXQRDTEEWMRHPQLXPDELRERXRRFIQYKGLATRGVDEVPILLVLPAARRRAPWRHLCRDLP

SEQ ID NO: 9435 - protein, 469 aa, Pseudomonas aeruginosa PAO1
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 9436 - protein, 137 aa, Glycine max
  unsure (1)..(137): unsure at all Xaa locations
KNKLLRTNNEKLTAGSMISCAAVTTVNRAGGDMVATFTGLMSMAGLPTTKTNDDISSIASNGGRVQCMQAXPPVGKKKFETLCYLPDLDDAQLAKEVEYLLRKGWIACWXFELDHRFWYREHNTSAEYYYXRYWTMW

SEQ ID NO: 9437 - protein, 332 aa, Thermoanaerobacter tengcongensis
MALYTLTIAVIFLYIFITGFHDEGNLIATIVCSRSIEAKKALIIASVAQFLGPLIVTTAVSTTIAKDIIKYSYLLNSGENISLLILSGILGAALWNFITWYYAIPSSSSHALIGGILGPFAIEYGFHSINFYGIMTKVIIPLFFSPVIGFAAGYIITLIFWKLLKNAQPSVNSFLKKLQYGTMFLLNIGQSANDAQKGMGLIVILMMIKGNTHNFEVPFFIKYIAAFMISFGLLFGGFRMIKSVGGRIYRVRPFHSFNAQLSSLLVVTAATLVGAPISGTQLVNSSILGVGARERPSAVRWQFAKAIFAAWITTIPASFIFSSIIYMVAKLL

SEQ ID NO: 9438 - protein, 546 aa, Zea mays
MGLGLGALLKSGGLSVSDHDAIVSINIFIALLCSCIVIGHLLEGNRWVNESITALVMGLITGGVILLVTNGTNSRILVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSVVLFNAIENLDIDNFDAIVLLNFVGKFLYLFFTSTPRRPPARLLSAYIIKKLCFARHSTDREVSIMILMAYLSYMISMLLDLSGILTVFFCGIVMSHYTWHNVTESSRVTTKHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTASGHTEVRVNAIMITSTVIVVLFSTMVFGLLTKPLLSLLIPPRTGLNTSSLLSSQSMLDPLLTSMMGSDFDVGQINSPQYNLQFILTAPARSVHRLWRKFDDRFMRPVFGGRGFVPFVPGSPVERSVPESHLGTVTEAEGS

SEQ ID NO: 9439 - protein, 579 aa, Glycine max
MNHLPRIFGNRKKQASDMDPTKKKKKSKGKKHQQPKLERRNAAKHFEYDAGSLCSSRDEYDASTSSSSSLHCTRSMELFDRKSFRIEGVEGEFDQICRSLGLSGPEDFSIPAAAWEAMKLRCSSDLLPRRPKHGGEEEEFDEEPKEKEKEEVEIAVLESEDRARVLDECVVPAESSGCCGGIKGFRPPMLKPPPGVRVSVVDDATCSTWDLMRDFAPKGEGGGKDNDHEREEKEEEEEEEEEEGEVGGVRVESVEEENAAAIAEIVGDFSGFSTSNEDDSSSTSTGPRSNNISPNGRIKRVITAGNWQKGELLGRGSFGSVYEGISEDGFFFAVKEVSLLDQGNQGRQSVYQLEQEIALLSQFEHENIVQYIGTEMDASNLYIFIELVTKGSLRNLYQRYNLRDSQVSAYTRQILHGLKYLHDRNIVHRDIKCANILVDANGSVKLADFGLAKATKFNDVKSCKGTAFWMAPEVVKGKNTGYGLPADIWSLGCTVLEMLTGQIPYSHLECMQALFRIGRGEPPHVPDSLSRDARDFILQCLKVDPDERPSAAQLLNHTFVQRPLHSQSSGSASPYIRRG

SEQ ID NO: 9440 - protein, 600 aa, Photobacterium profundum
MANDVLSVTVVFLAAAVVAVPIAQRLGLGSVLGYLIAGIAIGPWGLGLISDVEAILHFSEFGVVLLLFLIGLELNPKKLWQMRSPILGLGGGQVLVTSLVIASIVMACSSMMPSITWRDALVIGMGLALSSTAIALRIIEEKNLDGSETGQSSFSVLLFQDIAVIPMLAVLPILAGGGGGSWLDFAWMIGGIAALLVGGHFLLRPLFRWVVLSGVRELFNVAALLLVIGIALGMQSLGLSMALGTFLAGVLLAESEYRHELEIAIEPFKGLLLGLFFISVGMAVNLGLLFEFPLQILAAVAALVIVKGLLLYGLARLFGIRAKSRSQMAAILSQGGEFAFVLFTAAQGEGLLGTQLSSFLLVVVSISMMTTPLILLLQDRWFIHTFKSEDEALESDVIDREPRVIITGFGRFGQVVGRLLFANKIRVTVLERDPSQIQFLRKFGYKVYYGDATQLDLLRAAGADKAEAIIICTDEPDEVMEVVTLCQQHFPKLKVLARARSRVEAHQLLSHGVDNFSRETFAGALDLGRQALISLGMHPYKAKRAEAHFRKLDTTALRDLLPQHSEDVHLASRSKEARKELEEIFDREMRGERDRHNGWD

SEQ ID NO: 9441 - protein, 125 aa, Zea mays
PFARGGRPPPLPPRPVPGGREKAPLRKAHAFKQPGERFRSWDPARQDRFVRGFSALLGPPKVTPELRSLWIPPLPKWDASLGMKISPRLPMKPNMWCLMLVLHNKENACMLSPGTKIEKLSPPPP

SEQ ID NO: 9442 - protein, 333 aa, Escherichia coli CFT073
MSKVGINGFGRIGRLVLRRLLEVKSNIDVVAINDLTSPKILAYLLKHDSNYGPFPWSVDYTEDSLIVDGKSIAVYAEKEAKNIPWKAKGAEIIVECTGFYTSAEKSQAHLDAGAKKVLISAPAGEMKTIVYNVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKKATNNNESFGYTDEEIVSSDIIGSHFGSVFDATQTEITAVGDLQLVKTVAWYDNEYGFVTQLIRTLEKFAKL

SEQ ID NO: 9443 - protein, 172 aa, Nostoc sp. PCC 7120
MDLKSLIRDIPDFPKPGILFRDITTLLRDRQGLRYTIDFLAEKCSEANLNIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 9444 - protein, 208 aa, Zea mays
  unsure (1)..(208): unsure at all Xaa locations
MACNYANRLLSPHPHSHAKNDVPSGLAAVLLCAAVAAALGGKRAPIPDDLRDVIDDEEDDEWRRYGTPPSRGPGRGDXQPPDLSRMDPAALQDELLRGQTGPSFGFVKLRPGXRRSREDVVGIATRWSNVLRTGSVDAKFVAVNFVTLMFTMERGRDILELKEFVLSQAEAYELRIGDQVFRXPGDPPLDQVLRKPRKKKRRKSRDEL

SEQ ID NO: 9445 - protein, 120 aa, Glycine max
MAISSSSEIGWSWRVLCQRVNPAIPNTPLFLQIPKSTRFTGSSSVVARAWDPKTASSQEEDLVYVGKLVAGSFAGGAAIKYGSALFPEITTPNLVLALLLILTPVLVAVFLLIKESRTNP

SEQ ID NO: 9446 - protein, 204 aa, Berberis gilgiana
KRRNGLLKKAYELSVLCDAEVALIVFSARGRLYEYANNSVKTTIERYKKACSDSTNTGSVSEANAQFYQQEATRMRQQIGNLQNANRHLLGQDLSSVSVKDLKQMETRLEKGISRIRSKKNELLFAEIEYMQKREIDLQNDNMYLRAKIAENERAQQQMNLMPGNEYETITSAPYDSRNFLQVNLLPESNNQYSRSDQTALQLG

SEQ ID NO: 9447 - protein, 386 aa, Campylobacter jejuni subsp. jejuni NCTC 11168
MKNIFETLKDLENQISCLDESELISLEKAKDRILAKDLYARKNLPSFDNAALDGYAFNYTDINEALEIKGTIFAGDKNFYTVAKNECYKIMTGAKMPKNADTILMLEDECIEENKLIIKKVPKQYNAYRYKGEELKKGEILLQKGTKLNDKHIALLASQGLYKIEVIRKIRIGIFSSGNELKEPWQECDEESIYNANALPLLTMLQNASYLGIIKDDFKSTKEALENTNFDLLITSGGASVGEADFMEKALDELGFTPLFKGLKARPARPTKLYRKGENFVLILPGNPMAAYLSCFIFAKKIINLLSGNLDNPLTFYGKMGMDLKLKSGRNNLILGNLEKGIFTPFNENKFGSGMILPLIKSEFLLISEENTGELKKGDEITLLKI

SEQ ID NO: 9448 - protein, 487 aa, Oryza sativa
AAVAGAVALVAFCSYYLAVTRATGDGEARRRRRRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNVSYRTAITLAIDQDLHLTATAR

SEQ ID NO: 9449 - protein, 158 aa, Frankia sp. FE46
ITKEQYSRDPRNIAKKAEEYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKT

SEQ ID NO: 9450 - protein, 242 aa, Bacillus subtilis
MPYLKRVLLLLVTGLFMSLFAVTSTASAQTGGSFFDPFNGYNSGFWQKADGYSNGNMFNCTWRANNVSMTSLGEMRLALTSPSYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDEWLGSYNGVNPLYAHYDWVRYTKK

SEQ ID NO: 9451 - protein, 154 aa, Castanea sativa
MALSLFGGRRSNVFDPFSLDIWDPFEGFSAVANVPPSARETTAFATARIDWKETPEAHIFKADLPGLKKEEVKVEVEDGNVLQISGERSKEHEEKNDKWHRVERSCGKFLRRFRLPENAKVEQVKANMENGVLTVIVPKEEQKKTEVKSIEISG

SEQ ID NO: 9452 - protein, 450 aa, Oryza sativa
MYRVESPKIQNLNESHKWKVCRYNFAYQIKLKHQRSYGETRAACCCKKPNLELNQIRRKKKQIQPKGFFPYQREKPTVRPGRSSSSSSSFTNRARRASVDGGGARRGGGSEADSAAAARWWTACVGRRRWGSLSICYRYSGLKYHRVVDNRVIFLLESVPCEIRDSARFLSLVPVGTIWGFARLISDVDIWQLVLAYVAFSSPLPPPPPPISPPPPPPMAPSTALSPVAFKSSFSPLLFNPTPGRFPSSGAAASARARAEESSTAVFFGAQFDRGGLVSDAAAAHRFAWRSKINVEGAFCLPCYNRKKASNRSFRVYSLFGGKKDKDENGEEAPSKAGIFGNMQNLYETVKKAQMVVQVEAVRVQKELAATEIDGYCEGELIKVTLSGNQQPVRVEITEAAMEVGAEKLSELVNDAYKDAHQRSVQAMKERMADLAQSLGMPAGLGDGLK

SEQ ID NO: 9453 - protein, 131 aa, Schizosaccharomyces pombe
MDEELQAIRQARLAQLQAEHGSAPSNIASGPSSNQQQQEVQDEMRQNLLSQILEHPARDRLRRIALVRKDRAEAVEELLLRMAKTGQISHKISEPELIELLEKISGEVSKRNETKIVINRRVQDDEDDWDL

SEQ ID NO: 9454 - protein, 460 aa, Oryza sativa (japonica cultivar-group)
MAAAGRTLGCIYAGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 9455 - protein, 497 aa, Zea mays
MAICSAHTTTSLRSPWTAVKRKIGTLHIIAILISSCYLVAPQSTPTIPFSLSSPLQGPCHPHKAWTLGPAGGEEDKTNAAAGMMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPTQLIPNDDEGKVLRVKLIMKEGVDNFNPVYLFDEGSTISWVPCGRKLTCSYPGIKFAYGPDIYFGNEVSVLEMDGQFDRLDELIYVESHLSNLSTKFYGEVTQQMLKHADFPGSNNGTGLFQTIVGLKIRDLYEQIVAERAGAPVEAAKV

SEQ ID NO: 9456 - protein, 488 aa, Stictyosiphon soriferus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 9457 - protein, 168 aa, Staphylococcus aureus subsp. aureus MW2
MGEHQNVKLNRTVKAAVLTVSDTRDFDTDKGGQCVRQLLQADDVEVSDAHYTIVKDEKVAITTQVKKWLEEDIDVIITTGGTGIAQRDVTIEAVKPLLTKEIEGFGELFRYLSYVEDVGTRALLSRAVAGTVNNKLIFSIPGSTGAVKLALEKLIKPELNHLIHELTK

SEQ ID NO: 9458 - protein, 375 aa, Kluyveromyces lactis
MFRLARAQTALANKASVSRSFLRLNSSFAIPETQKGVIFYENGGKLEYKDLPVPKPKANELLINVKYSGVCHTDLHAWKGDWPLPVKLPLVGGHEGAGIVVAKGENVKNFEIGDYAGIKWLNGSCMSCELCEQGYESNCLQADLSGYTHDGSFQQYATADAVQAAQIPKGTDLAEIAPILCAGVTVYKALKTADLKPGQWVAISGAAGGLGSLAVQYRKAMGLRVLGIDGGDGKEELFKQCGGEVFIDFRKSKDMVADIQEATNGGPHGVINVSVSEAAVSMSTEYLRPTGLVVLVGLPADAYVKSEVFSHVVKSISIKGSYVGNRADTREATDLFTRGLVKSPIKIIGLSELPEAYALMEQGKILGRFVVDTYK

SEQ ID NO: 9459 - protein, 773 aa, Sulfolobus acidocaldarius
MEIELSAGAEVSPSGKKELVLRVVEAKQKDVGRGKVRIDIDLLSQIGVNPGEVVELEGQRKTAAIAWPLAPEDVLNDEDKYIIRMDGITRKNAGVSIGDKVIVRKSNPKVATSVRLAPSNFSITVDPGFISYVKKKLKDTPLVEGDTVLIPVLGQAIPFTVVQVRPQGIVIVSDETSITISEKPVEQTRYPRVTYEDIGGMKEIIQKIRELVELPLRHPELFKRLGIEPPKGILLYGPPGVGKTLLAKAVANETDAYFTSINGPEIMSKFYGESEQRLREIFEDAKKHAPAIIFIDEIDAIAPKRDEVIGEVERRVVAQLLTLMDGLENRGNVIVIAATNRPNAVDPALRRPGRFDREIEIPLPDKQGRLEILQIHTRNMPLSKDVDLHKLAEMTHGYTGADLSALVREAAMNALRRYIQMIDLSQDKIPPEILEKMEVRMDDFLKAFKDIVPSGLREIYIEVPEVHWFDIGGLEEVKEELREVVEYPLKYREVYENMSIEPPKGILLFGPPGTGKTMLAKAVATESGANFIAVRGPEILSKWVGESEKAIREIFRKARQAAPTVIFFDEIDSIAPIRGLSTDSGVTERIVNQLLAEMDGIEKLENVVVIAATNRPDILDPALLRPGRFDRLIYVPPPDKTARFEILKVHTKNVPLAEDVSLEDIAEKAEGYTGADLAAVVREAALRAIREQMAECMGEANNECKKSDIECREKKIRDCMAGKGRIVERKHFDVALKKVRPSVTQDMIQFYQNWLEKARQQLPRTNIKPSTFT

SEQ ID NO: 9460 - protein, 479 aa, GIBBERELLA ZEAE PH-1
MSSLATKQQSLKIFEKLKTKPANKICFDCGQKNPTWTSVPFGIYLCLDCSSNHRNLGVHISFVRSTNLDQWQWDQLRVMKVGGNESATKFFQQNGGTAALNSKDPKTKYQSNAATKYKDELKRRAARDAQDYPTEVIITDAIDDGSATPAGEPDDDFFSSWDKPAIKRPTPPVSRTGTPPVVGRTPSPFLNSGNGKDIARTASPLSRTSTGENKPASRITTSAALRKTPASTGPRKANVLGAKKTTKLGAKKVTADIIDFDEAERKAKEEADRIAKLGYDPDAEEDPATKNSGSAAAIISPTPVAPSRGSASSHTRQKSDAEVERLGMGMNRLGFGQVGGPKAAASSAPKRNAGGFGSVGPVRAQDVDDSERYAREKFGTQKGISSDEFFGKGAFDPSQQSEAKTRLQGFEGATAISSNAYFGRPEDEPEEEYGDLESAAKDFVRKFGITAGDDLENLTQMAGEVSTRLQGAIRSYLGN

SEQ ID NO: 9461 - protein, 225 aa, Zea mays
MDAADARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQFEETEDENEESNPSLTPNPANSNPTFSQDQRSNEQQHTPQHGQRVSFQLNAVAAAAAKRPRMTVDQLNIG

SEQ ID NO: 9462 - protein, 374 aa, Bromheadia finlaysoniana
MAPVPFLPTAVTENTLRESFVRDEDERPKVAYNVFSHEIPVISLRGSTMREMEVEIEICWKIVAACEDWGIFQVVDHGVDAGLIADMTRLAREFFELPPEEKLRFDMSGGKKGGFIVSSHLQGEVVQDWREIVTYFSYPIRTRDYSRWPDKPEGWRAVVEEYSAKLMELACNLLGVLSEAMGLDREALAQACVDMDQKLVVNFYPKCPQPDLTLGLKRHTDPGTITLLLQDQVGGLQATKDGGETWITVQPVQNAFVVNLGDHGHYLSNGRFKNADHQAVVNSNCSRLSIATFQNPAPDGVVYPLAVREGEKPVMEEAITFAEMYRRKMSRDLELARLKKMGKMESKQKGAAGENAEAIGAAATKPKALNEILA

SEQ ID NO: 9463 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTDVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 9464 - protein, 84 aa, Triticum aestivum
MKVKILQWHAVASWTWDAQDETCGICRMAFDGCCPDCKFPGDDCPIIWGACNHAFHLHCILKWVNSQTSIPLCPMCRREWQFKG

SEQ ID NO: 9465 - protein, 580 aa, ASPERGILLUS NIDULANS FGSC A4
MPEPSLSSSHHGSHHGSQRDEAILSQHLDPQYTAALHEEAILPDNGDGTASNATDVSEPQSSLLLQGGDMHRDLYRLDAKTKRARMDKRAATFSAAPRGSDLFEEAVAPLEPGSFRRNFIRQQGQDHPALHRSFLEYLDLYGNFAGEDLEESEEETEQGEEETQQEAERRPLLGTQRHRRSRSYRPGDASNVKTFFTLLKAFIGTGIIFLPKAFRNGGILFSSVALVTVALISTLCFHLLLECRRRYGGGYGDLGEQIAGSKLRSLILSSVAISQIGFVCACIIFTAENLRAFFVAIMPETVHSLSTLRLIVLQLVVLIPLTMIRNISKLGPIALLADAFILFGLGYIYCYDIASLASRGLAPRVDLFNSDSFTLTIGSCIFTFEGIGLILPIQSSMKKPQCFDNLLYTVMFIITVLFTGVGALSYATFGADTKTEIISNLPQNSRLVNTVQFLYSIAILVGTPIQLFPPVRIIEGNLFGSASGKRDPGIKWKKNSFRTVAVLACGVIAALGAGDLDKFVSLIGSFACVPLVYIYPAYLHWKGVAESPWAQRGDIAMMVLGFGFMVYTTAATVSVWVADS

SEQ ID NO: 9466 - protein, 523 aa, Yarrowia lipolytica
MSNALNLSLALGVFLLAYYGFSVIQYRIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 9467 - protein, 267 aa, Zea mays
  unsure (1)..(267): unsure at all Xaa locations
MKNVAKCDTWCELQNPANHRVFERKLRPKPSGGGHVCLGVTRCQPRVSSPSPSASASAPPFRPRVRVAAPLGVRVTGGRRGQAVVAMASADARLAGIASSIRVIPDFPKPGIMFQDITTLLLDPKAFRDXTSTSSVERYKDQGITVVAGVEARGFIFGPPIALAIGAKFVPLRKPKKLPGEVISEEYSLEYGTDKIEMHVGAVQANDRALVVDDFIATGGTLCAAVKLIERVGAKVVECACVIELAELKGRDKLGDRAVFVLVEADA

SEQ ID NO: 9468 - protein, 394 aa, Oryza sativa
MGSFGRLARRAVETEAPVMVKMQELLRGNKDVMSLAQGVVYWQPPEAAMNKIKEIVWEPSISKYGSDDGLPELREALLEKLRRENKLTKSSIMVTSGANQAFVNVVLTLCDAGDAVVMFAPYYFNSYMSFQMTGVTDILVGASNPETLHPDVDWLEKVLQENNPIPKLVSVVNPGNPSGAFIPKPMLERISELCRNAGAWLVVDNTYEYFMYDGMEHYCLEGNHIVNLFSFSKAYGMMGWRVGYIAHPNEADGLHAQLLKVQDNIPICASIIGQRLALYALEAGPEWIRERVRDLVKNRELLMEAMSPLGKDSVKGGEGAIYLWAKLPEKCSDDFEVVRWLANKHGVAVIPGSASGGPGYIRVSFGGLKESDTRLAAERLRRGLQELVTEGMVQ

SEQ ID NO: 9469 - protein, 1268 aa, Magnetococcus sp. MC-1
MVGIMLDKSLLDLLWVTLCIGLVLLMQAGFLCLESGLTRSKNSINVAMKNLVDFSVSVTAFLALGYPLMFGTSMEGWLGWGTPFSIGSEEPLQMVFFLFQAMFCSTSVTIVSGAVAERLGFRAYLFLAAGMALLIYPIVGHWAWNGLDRGLSLGWLGQAGFVDWAGSTVVHAVGGWFSLALLLVIGPRTGRFNPDGSVNPITASNLPLTTLGALILWFGWIGFNGGSTLSLDARIGPVVLATCLGAVGGSMGALLWSWWREGRPSVLSAINGTLAGLVAVTAGAHALSPLAALGAGLLAAPVALLMENWMLRHGIDDAVGAVPVHLGAGVWGTLAVALLGDLHKLGTGLSRLEQLWAQLQGVLAAALVAFVIPWLVLRVINRRFPMRVTPEQEWQGLNISEHGTQTELSSFLGVLRAQAEGGDLSLRAEVDPFSEVGLIADRYNHVMDAMEAAVAKTRAVFQTAGDAILIIDPHSGQITAHNPMAEAVFGRSSAAFAHLTLSDLVVGVTPQRFWLGLHEEGEGRLPDGHTFPLELAITRASHGDGEMLIGTFRDIRARKQAELAIKASEARFRTLFASAALGMALIDAKQRVVDANPALMQMLELSHHRDALPPLAQLAHPQDQQEVAARLDAVIEGRSPQENCEVRCLCEARHLTIWTRMVISPIVLESNLTPMVVVIVEDVTQRRRSEEALRLAATVYESTNESVVIFNGEGRVEQVNQAFCRLSGYTAREVRGLELRHLLSARYEKSQFDEMAQALALTGHWSGEVMGQRKQGALASERLSLSLVRRPDGSTQNTIAVFTDLTEQKAQEELIWRQANFDPLTSLPNRRLFQDRLHQALAQADRSAGRVALFFLDLDRFKPINDTMGHQAGDELLQKCAERINAAVRSSDTVARLGGDEFTVILPNIQNGQDLSRIAEGIIKTLTEPFYLKAGEANISTSVGVAVYPDDSQDDEGLMRAADAALYQAKDHGRNNVQFFTESLNQQILERIALEKGLRRGLGAGELFLVYQPQVEVSSGRLSGAEALVRWRLPTGEVVMPDRFIPMAEESGLIVQVGEVVVSLAVQQIRAWLDAGFEPPRISINASPKQFHLDGGGLTSILMSTCDAYQISPSRLAVEIVESGLMANPERSGEILAGLAKLGVEVELDDFGTGYSSLARLSRLQIQALKLDRRFLVGIPEDPQNRILVTAMVQMARGMGIEVIAEGVEDLRQMGFLQDLGCHRAQGFGIARPMEPEAFVVFCQTPKLEHPPYGNCIVGWAAPEPVRT

SEQ ID NO: 9470 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 9471 - protein, 186 aa, Triticum aestivum
  unsure (1)..(186): unsure at all Xaa locations
GCGGGGGSGAPRRSREYKLCSAHTEGTPPLYPSGFNLIDPRYYDVFAPVGGNRVTTYRGLPDGNLAVLXQAYIDADDAQSFYTLSWACDLDGTPLLVAAGSNAVIRVINCANREFVKSFLGNGESLIGIXXQPLXLRLNSASKDNLXLWNVNTRYXILIXLGGRSHRNEXLXVDSTFQRIAWKVIR

SEQ ID NO: 9472 - protein, 173 aa, Flaveria trinervia
MASIPATVAAVPQTNMVAPFTGLKANAAFPVTKKVNGFSTLPSNGGRVQCMKVWPPVGKKKYETLSYLPELTEAQLAKEVDYLLRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 9473 - protein, 196 aa, Mitthyridium sp. Wall 1/14/97
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIALSDTFVKL

SEQ ID NO: 9474 - protein, 330 aa, Escherichia coli
  unsure (1)..(330): unsure at all Xaa locations
TIKVGINGFGRIGRIVFRAAQKRSDIEIVAINDLLDADYXAYXLKYDSTHGRFDGTVEVKDGHLIVNGKKIRVTAERDPANLKWDEVGVDVVAEATGLFLTDETARKHITAGAKKVVXTGPSKDNTPXFVKGANFDKYAGQDIVSNASCTTNCLAPLAKVINDNFGIIEGLXTTVHATTATQKTVDGPSHKDWRGGRGASQNIIPSSTGAAKAVGKVLPELNGKLTGXAFRVPTPNVSVVDLTVRLEKAATYEQIKAAVKAAAEGEXKGVLGYTEDDVVSTDFNGEVCTSVFDAKAGIALNDNFVKLVSWYDNETGYSNKVLDLIAHISK

SEQ ID NO: 9475 - protein, 154 aa, Oryza sativa
MRAILIDWLVEVAEEYRLVPDTLYLTVNYIDRYLSGNEINRQRLQLLGVACMLIAAKYEEICAPQVEEFCYITDNTYFRDELFIVQDPALHLEFLANYVAELSLLEYNLLSYPPSLVAASAIFLAKFILQPTKHPWILHAADVIDLNMVIQREA

SEQ ID NO: 9476 - protein, 491 aa, Oryza sativa (indica cultivar-group)
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSQETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIAVRRRVAHPKVSPELRAIWVNYLSQCDESLGVKIANRLNVKPSM

SEQ ID NO: 9477 - protein, 192 aa, Thermococcus kodakaraensis
MIVLVNNRDSFVWNLAEYASLFDRVKVVPNTITVGELRRLDPDGVIISPGPGHPLERREVGNSPEIVLEAGVPILGVCLGHQIIATAFGGKVGRVKPRHGKASPVKHDGKGVLRGIKNPLTAGRYHSLAVLEVPREFDVSAVSLDDNVVMGIRHRKLPIEGLQFHPESVLTEWERKEGLRIIKNFVEMSRNG

SEQ ID NO: 9478 - protein, 183 aa, Zea mays
MSCAGLVQTWAAVIMGVFAGSVPWFTMMILHKKVALLTRVDDTLGVFHTHAVAGLLGGVLTGLLATPELLEIESPVPGLRGAFYGGGIRQVGKQLAGAAFVVAWNVVVTSLILLAIGLLVPLRMPEDQLMIGDDAAHGEEAYALWGDGEKFDATRHDAVRVAGVMDREGSAEQRLSGGVTIQL

SEQ ID NO: 9479 - protein, 174 aa, Yersinia aldovae
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRF

SEQ ID NO: 9480 - protein, 330 aa, Helicobacter pylori 26695
MPIRIAINGTGRIGLCAIRVASQRKDIEIVAINSTAELETLLHLIRHDSVHGHFEAQLNADRTLNIGHSKNILVLSERDINKLDFSAANAEIIIECTGKFNSLEASSAHLKNSVKKVIISAPAQNTPTFVYGVNHKNYHNESVISNASCTTNASAPLLKILDEAFKVENALLTTIHSYTNDQNLLDTKHKDIRRARAAGLNLIPTSTGVSKAISLVLPHLGPKVTGLAIRVPTPNVSLVDLSLNFKKSVSKASVQHALKDACKHAFKGVVSIDEERLVSSDFISSPFSAIVIDDQIMTIGEKNAKVLAWYDNEMGYSERLIDMAQYIAQN

SEQ ID NO: 9481 - protein, 333 aa, Cytophaga hutchinsonii
MKIIIPMAGMGKRMRPHTLTVPKPLVPIAGKAIVHRLVEDIAKVCGEKIEEVAFIIGDFGKETEKRLIKIAESVGAKGSIYYQREALGTAHAIYCAKESLGGKVVVAFADTLFKADFTLDTSNEGIIWVQKVEDPKPFGVVKLNDKNEITDFVEKPEHFVSDLAIIGIYYFQDGENLKKELQYVIDNDIKDKGEYQLTSALENMKNKGIKFLPGKVTDWLDCGNKDSTVDTNSRYLEYIKDQNLVAPTVKLVNSVIIQPSYVGENVELTNSIVGPYASIGNGTKITNTVINRSIVQENAVITNATISNSMFGNSAQYKGKALDLSVGDFNVIA

SEQ ID NO: 9482 - protein, 459 aa, Porphyra fallax
DADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 9483 - protein, 545 aa, GIBBERELLA ZEAE PH-1
MGILTLKEDRPTPKAVYNWRVYACAAIASMAACTIGYDSAFIGTTLALPSFVQEFNFESYDPAALALTKQNIVSVYQAGAFFGSLFAYVSSYFLGRRWSLIIFSAVFMVGAGMMLGANGDRGLGLIIGGRVLAGIGVGGCSNMTPIYISELAPPAIRGRLVGLYELGWQAGGLVGFWINYGINQHLPYSPGQNENVWLIPFAVQLIPAGLLMVGAVFIPESPRWLFSKGKREQAIKNLCWMRNLSQDDVYIVEEINFIDAEIDRYHSAVGAGFWKPFAALKNRKVQWRFLLGGLLFVFQNGSGINAINYYSPTVFKSIGITGTNTSFLTTGIFGVVKTTLTFVWLMVLIDHMGRRNLLMIGAAGGAFSMYFIGAYIKIANTEAKLASGQDVSLSSGGIAAVFFFYLYTAFYTPSWNGTPWVLNSEMFDQNTRSLGQANAAANNWFWNFIIARFTEQMFRAWGFGVYIFFASLMILSIFFVFFCIPETKGVPLEAMDKLFATKPIWKANKIVMEDLRLQEEEFRHNADGVDMREEKAKAEQIEGAA

SEQ ID NO: 9484 - protein, 175 aa, Oryza sativa (japonica cultivar-group); identical to SEQ ID NO: 5764

SEQ ID NO: 9485 - protein, 426 aa, Neisseria meningitidis Z2491
MENSLKEAALKFHELPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 9486 - protein, 903 aa, Zea mays
MSPLPRALPRSLAFLGWVLLILLPARAADAGPLATELLRPPFTASNILYVDTGGAFLESTSGAFRAAVFNPGKQQDRFYLAVLHVPSATLVWSGNRDAPTTSSGPVNLTSQGITVSKPDGTLLWSTPSQLRSPVVALRLQDSGNLQLLGAGNATLWQSFDTATDTLLPGQLLRAGAYLSAATSATDLAEGNYRLGVTAADLVLTWQASTYWRLSNDARSYKDRNAAVASVSVNASGLFAVAADGGLVFRVNIGAAAFPVLSLGYDGRLRITSYALVNSSASLGSDFVAPANDCDLPLQCPSLGLCSPAAGNSSTCTCPPLFAASATTPGACTPGDGSALASPALCQSNNSTVSPSYLALKSQVAYFATKFDPPIKTGVNHNACRGLCSTSCGCLAYFYDNLAQSCYLIQDKQLGSLYFSSSASALGYIKTVPSANNATRNNPSSSSANRAIPIILPSIAAFLLLAVIICYLCWRRMSKNGKKRKGKGTGVKQVYMGRQKDTGSADDDEDDDNVVVPGMPTRFSYMEIAAMTANFGTKIGSGGFGSVYKGELPGVVEGLVAVKKLEAVGVQAKREFCTEITVIANIRHVNLVRLRGFCAEGSRRLLVYEYMNRGSLDRSLFGRTGPVLEWGERMEVALGAARGLAYLHTGCDQKIVHCDVKPENILLADGGQVKIADFGLAKLMSPEQSALFTTMRGTRGYLAPEWLSNAAISDRADVYSFGMVLLELIHGRKNRGEQTNDNAAVAVAAAGSSVQSDWPSGWSSATATSSPSGASGSSDEYFPMVAMELHEQGRHLDLVDRRLEGRVDGAEAARAVRIALCCLHEDPAQRPSMAAVVRMLEGTVAPPEPRVEALGFLRLYGRGHAVPNTSLIAMAGTSGSAGTSSSMAGVAQLTDTSQSVSAPR

SEQ ID NO: 9487 - protein, 313 aa, Pseudomonas syringae pv. syringae B728a
MTSKLDQLKKFTTVVADTGDFGAIKSLEPEDATTNPSLLLKAASDANNAKMLGEAFDGSKGDIGLACDRFAVAIGQEILKVVPGRVSTEVDARLSFDTNALIERSERLIGLYDAAGIKRDRVLIKLAATWEGIRAAEKLEKDGIQTNLTLLFSFAQAVACAEAGVFLISPFVGRIYDWYKKSTGTDYTGAEDPGVQSVTRIYNYYKANDFKTVVMGASFRNLNQIEQLAGCDRLTISTDLLKKLAEDTGTLERKLTPDKAGEKRSDTVKNLTESQFRWASNEDAMATEKLAEGIRQFARDQEKLEALLSAKKA

SEQ ID NO: 9488 - protein, 165 aa, Aegilops searsii
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 9489 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 9490 - protein, 325 aa, Phalaenopsis cv. 'True Lady'
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDGEWIDVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 9491 - protein, 320 aa, Leuconostoc mesenteroides subsp. mesenteroides ATCC 8293
MKKILVLHTGGTISMHEDADGDVETGDENPLVQAKVTFPNIELEVENIFNLPSEHIGPSHMLQLQKRISEAKNDFDGVVITHGTDTLEETAFFLDSTLKVSFPIVITGAMRSSNELGSDGLYNYQSALRVAADDTSKNRGVIVVMNDEIHAARFVTKTHTTNVATFASPLSGTMGLLTKRQIIYFYDLPQREVLPDVDINKNIPVLKAYAGMDGQLLKILADANIDGIIIEALGAGNLSREAARGVAYLLAKNTPVVIVSRSFNGVAAPVYDYLGGGVQLEKSGAIFASSINGPKARLKLLIGLSNNLSKEHLETYLHGI

SEQ ID NO: 9492 - protein, 361 aa, Tropheryma whipplei str. Twist
MSAKNYKKTLLVNPISQDELQKRLSAPGFGSVFSEHMVSADWHRDLGWHDYRVEPYGPISLAPSAMVFHYGQEIFEGLKIFRHSQDSSVRAFRPLENAKRFQKSSERIALPVLPVEDFLQSLREWVMVDGRWVPNAPSCVYARPFMIATEEALGLRATCSARYTLICCPVGDLFGQIRPIRVRVSSKYSRASRGGTGSVKFGGNYAASILPQVEAGNDGFDQVLFLDSASYKNIEELSASNIFFVLSSKTLITPSLGGTILPGVTRDSIIRIAEDLGFVVEQRQISLDEVTHLFSQDKVTEMFCCGTAASVTPIGSVSFDGGTLGSGQAGPVTMLLREYLRDIQFGNRPDKYNWMVNLEDT

SEQ ID NO: 9493 - protein, 181 aa, Lycopersicon esculentum
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 9494 - protein, 356 aa, Glycine max
  unsure (1)..(356): unsure at all Xaa locations
MEDLNGDTVGNLNQNAAKPPRDHTVMRHCSSSSWSAEPESNINIVGLKSSTEEKPDFLVVLRSGCCSDKGPKQYMEDEFICADILSECVDLREDLPSPAAFYGVFDGHGGVDAASFTRKNILKFIVEDAHFPCGIKKAVKCAFVKVDLAFRDASALDSSSGTTALIALMLGSSMLIANAGDSRAVLGKRGRAIELSKDHKPNCTSERLRIEKLGGVIYDGYLNGQLSVARALGDWHIKGSKGSKSPLSSEPELEEIVLTEEDEFLIIGCDGLWDVMSSQCAVTMVRTELMQHNDPTTCAKVLVFEALQRNTCDNLTVVVVCFSKDXPPKIEIPRSYRRRSIXAEGLDLXKGVLNGR

SEQ ID NO: 9495 - protein, 117 aa, Halobacterium sp. NRC-1
MSGNPDDDRLEELRQRKKEQLKQQQQGGDAEREAQQQQAQQAEQQKQAMLKQNLTDGARKRLNTIRMSKPEFAEQAEQQVLALAQSGRVQGRIDEDQMKEILRELKPDSQSFNINRR

SEQ ID NO: 9496 - protein, 277 aa, Oryza sativa
  unsure (1)..(277): unsure at all Xaa locations
SPSSPSSSSGSDDFAALLDAELELTSAADSASAGDPSAATDDDDEGGDEEEEDVVVSSKDVKIDECPPHPGFFGGLCYRCGKRQDEEDVPGVAFGYIHKGLRLGTTEIDRLRGADLKNLLRERKLVLILDLDHTLINSTKLFDLSAAENELGIQSAAKEGNCSCSGXSLFTLETMQMLTKLRPFVRRFLKEASDMFEMYIYTMGDKAYAIEIAKLLDPDNVYFGSKVISNSDCTQRHQKGLDVVLGDESVAVILDDTEYVWQKHKENLILMERYHYF

SEQ ID NO: 9497 - protein, 488 aa, Pterocladiella capillacea
  unsure (1)..(488): unsure at all Xaa locations
MSNSVEERTRIKNERYESGVIPYAKMGYWDPDYXXKETDVLALFRVTPQPGVDPVEASAAVAGESSTATWTVVWTDLLTACDLYRAKAYKVDDVPNTNDQYFAYIAYDIDLFEEGSIANLTXXXXXXXXGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIVMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVIARNEGRDYVAEGPQILRDATKTCGPLQTALDLWKDISFNYTSTDTADFVETPTANV

SEQ ID NO: 9498 - protein, 1796 aa, Neurospora crassa
MSSVKQSAQAATSDVVDTAKNATAETVTAATDFLHTPAVRAALPFINGGLSGMVATTVIQPIDMIKVRIQLAGEGKAGGPKPTPLGVTRDIIASGKAMDLYTGLSAGLLRQAVYTTARIGCFDTFMSRLSARAKEKGQSVGFKERASAGLAAGGLAAMIGNPADLALIRMQSDGLKPVAERKNYKSVIDALGGIARNEGVAALWAGAAPTVVRAMALNFGQLAFFSEAKAQLKARTQWSSKVQTLSASAIAGFFASFFSLPFDFVKTRLQKQTRGPDGKLPYNGMVDCFAKVAKQEGVFRFYRGFGTYYVRIAPHAMVTLLVADYLGWLTKQMFGVLGCVAYPSPIHPDYHAGPASTIAFDNQDELLWIGTQKGFAGSFIGRELKRFTAFRIHPETDGPLRQFLFVDKGVIFLGSRSVYMAARSGVPIWSIRHESMQDLRAMSFTSKGTSEILVAGWQNKMLVIDVNKGEVVKELPTQDQYSFLKMSRYICAATNKGTVNILDPITFTIKKQWQAHGAFINDLDTSNDFIVTCGGSHRQTHNTPAILDPYVKVFDLKNMSAMNPVPFAPLAAHVRMHPRMLTTAIVVNQAGQIHVTDLLNPSNSQVCYTQPQGVVLHFDVSRTGEGKALADNKHNTYVWGSPNKIQFTEIGIPPRLPDPPQPSLLPPDPDMLEELPLSRIGLPYYREQLFSALPPDIISDVGAPPQQIDPNILSTLTKTDWGYIGPNKTGLQRNQYMDTRSTMKTSNTIRAPKFLSEKARESQTGSEDNTLATNETAMMTPNNDHWSLRPEAPPEYRICEIKYSKFGVDDFDFGFFNNTPYPGLENNITNSYANSLLQVMHYTPLLRNMALQHAATACLADPCLLCELGYVFDMLQKGEGPSCHATNMLRALNHTSNASVSGVLEDIAKDKNPSTLVKNLTMFLFDKISQDYKGTPPISTELERTLFKLNQPPNPLDLVKRLLETDARYQIKCMHCQHVSPRTATTFVNKLCYPAAKPNIRGMKAQRITFSQVLKAGLENEAVNKGYCTKCQRYQNLDQRKIIFNIPAVLALCTEITTAEHRKLWSTPGWLPEEIGIIVDQGHVYCYEGDDLKLHLNRGIHNITVYSLVGTVVNVETKSPQKSHLVATVNVGRAEPESKDQDRWHLFNDFSVRGISKVEALTFNAAWKMPVVVMFQVKAANHRFNMDWKTRLDTSVLFRDNNPHALKTYELLDRETEIPGPDTVIAIDTEFIRLKEREIHIDEDGKSKTIRPISHAIARASVVRGQGSREGVAFIDDYIHIKETIVDYLTEWSGITPTDLDPINSQRNLVSPKTAYKKLWVLVNLGCKFLGHGLSQDFRVINIQVPRNQVIDTSIIFMKPPSQRKISLAFLAWYLLKEDIQQNTHDSIEDAQTALKLYRKYEEFMANGSFHDVLEALYKKGKTLNFKPPRISTGAAKDAGFGAVHRVGTPPVPAPGTTEGSFEISNSSTATTGGSALSATGGMGSASASSSMPSTPVRKPIGLGGPFTVAGVVKPSPATSLDNFGAGAVGTGITTAAATMGGGYGGYGTDGAYWGGPNDMAPTSMIGGSAFIPAKFPPGPPETRGFIPYRPQVLLAEREAAAAAAAAAAAAAANNDVGGRGGVACGNGGAGGEQGKQDEESDNDEMRRQQQELFAPEPYAPGFEQNLFEASRRDEGSPVVEYVSPPAVEEDDSSTIKEVSSPVVKEVASPTASLSSPAAVVGEEEEKQKDEDVPPAIEEAAADPSVTTGSSSTLAAEKQRKQEEEEGSSAVGGGGGGEEGKQEKQDDQGSTPALAP

SEQ ID NO: 9499 - protein, 222 aa, Desulfovibrio vulgaris subsp. vulgaris (strain Hildenborough)
MILSPSLLSSDFGRLTEELAALEAAGVKWVHWDVMDGRFVPNITYGQPVISHLRKKSGLFFDVHLMVHEPERYLADFAKAGADMLVVHAEATNHLQRTLAEIRRLGCKAGVALNPHTPLSVLDYVLEDVDMVLIMSVNPGFGGQKFLPATYRKIRDLRAMLDARGLSAHIQVDGGVDPSNTAALVESGADVLVSGSAFFGFPPYDQRLRAFEDAAAAARPAN

SEQ ID NO: 9500 - protein, 233 aa, Xanthomonas campestris pv. campestris str. ATCC 33913
MGLLHFPELPMQPTAIAPSILSADFARLGEEVDNVLKAGADWVHFDVMDNHYVPNLTIGPMVCQALRKHGITAPIDVHLMVEPVDRLVPDFADAGATTISFHPEASRHVHRTIQLIRSHGCQAGLVLNPATPVDILDWVLPELDLVLVMSVNPGFGGQAFIPSALDKLRAIRSKIDALGKPIRLEIDGGVKADNIGAIAAAGADTFVAGSAIFNAPDYSQIIAQMRAAVDAAR

SEQ ID NO: 9501 - protein, 362 aa, Oryza sativa (japonica cultivar-group)
MALDTLCSAGGDVLIYDTFNASAAAAAAVVPPASFLFGNNNAGGAAGTETRVQVAAGAVPEVDQLLKQAQQPGRRKRRRRARSCKSREDAESQRMTHIAVERNRRRQMNEYLAVLRSLMPESYVHRGDQASIVGGAIDFVKELEQLLQSLEAQKRTLLMQPPPPPQQQREPKCDAADSTSAADQETPAAAAAAAAADGPPFARFFTYPQYVWCHNPAQDGGGGGGAAAENRAGVADIEVSLVETHASIRVMAARRPGQLLKMVAGLQALRLTVLHLNVTALGSLALYSISVKRFHGGKAIASLGPLGVFFLCALYLWYSTTVVEEGCGMATVDDIAAAVHHVLCIIDAEAASQMLLAGEASG

SEQ ID NO: 9502 - protein, 317 aa, Corynebacterium glutamicum
MTESGSTASPLCGVGSSVMTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 9503 - protein, 239 aa, Zea mays
RHTHERRNPTRPPRTTAPTMDAGAARPSAPSTAAVAGASVADEPRDARVVRELLRSMGLREGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEETEDETGEPNPSNPANSNPSYSQDQSNKEQQQQHTPQHGQRVSFQLNGSAAAKRPRMTIDQLNMG

SEQ ID NO: 9504 - protein, 393 aa, Lactococcus lactis
MKKCSDFVLKMDESVTLAAANRAKALKAQGRDIIDLTLGQPDFPTPKKIGQAAIEAINNGQASFYTQAGGLPELKKAVQHYWTRFYAYEIQTNEILITAGAKFALYAYFMATVDPLDEVIIPAPYWVSYVDQVKMAGGNPVIVEAKQENNFKVTVEQLEKARTSKTKILLLNSPSNPTGMIYSKEELTAIGEWAVAHDLLILADDIYHRLVYNGAEFTAISSLSDEIRNRTTVINGVSKTFAMTGWRIGLAVGDPEIIAAMTKIASQTTSNPTAVAQYAAIEAFEENDKSFEKMHAAFEERLNKIYLQLSEVPGFELVKPNGAFYLFPKVTKAMAMKGYTDVTDFTTAILEEAGVALVTGAGFGSPENVRLSYATSLETLEAAVTRLKDWMND

SEQ ID NO: 9505 - protein, 393 aa, Oryza sativa
MATSYREGQPDLRYGKLETGKQRTCSLRSVDPIHWPKMETSHEPQTPWRLARRRVTHSMPPEKAEVFRSLEGWARSSLLPLLKPVEECWQPTDFLPDSSSEMFEHQVHELRARAAGLPDEYFVVLVGDMITEEALPTYQTMINTLDGVRDETGASACPWAVWTRTWTAEENRHGDILGKYMYLSGRVDMRMVEKTVQYLIGSGMDPGTENNPYLGFVYTSFQERATAVSHGNTARLARAHGDDVLARTCGTIAADEKRHETAYGRIVEQLLRLDPDGAMLAIADMMHKRITMPAHLMHDGRDMNLFDHFAAVAQRLNVYTARDYADIVEFLVKRWKLETLETGLSGEGRRARDFVCGLAKRMRRAAERAEDRAKKDEQRKVKFSWIYDREVIV

SEQ ID NO: 9506 - protein, 529 aa, Zea mays
MSSVGRSNGTRAANGAAAISTSTTEAGSADARFHSQLLHQDRQSRWAGCFSGLSCFGSQKGGKRIVPAARTSDGNGSNTRGNGLQSGANSNQNLPMNLSLLAPPSSPASFSNSALPSTAQSPNCFLSVSANSPGGPTSNMFAVGPYANEPQLVSPPVFSTYTTEPSTAPLTPPPELAHATTPSSPDVPYARFLSSSMGIKTASKDHNMPFLSTTYSGGSGLQTSYPLYPESPCSSLISPASVTPRTGLSSPIPEQEVPPAHWKTSRSACDTPYFRASPIPEQETTAQWKTSRSACDTPYARTSPTNIFGLDSSTPRNYMLDNNFFRPAASAQFYLDQAQQAFSHNGGRVSVSREKQGADEIEAYRASFGFSADEIVQSQSYVGIPDAVDESFSISPFGNNTPATEICPFSDLPNEVENEDKSCAYAKDGTSPKKSANQLSTDSPNKVLRLDVFKGTKGGHQSEDECIRKDGHLFRKTADEISLKPIEVRKKSLPGHSCSDAEIEYRRTRSLRDANGVLSRRSALARQLH

SEQ ID NO: 9507 - protein, 259 aa, Zea mays
  unsure (1)..(259): unsure at all Xaa locations
MALSISAPTSSPFLPAPRQVGRWSSSPSSAKPAVFSLRRPVVVARAAAGNAPSSPAGAVVTEFDVVSSFSEIVPDTVVFDDFEKFAPTAATVSSSLLLGIAGLPDTKFKSAIDTALVDGECNTMEKPGDRMSCYLTKALGNVGAELAHQVPGRVSTEIDARLAYNTQGIVQRVHELLQIYNEHDIPSERLLFKIPATWQGIEASRLLESEGTQTHLTFVYSFAQAAAAAQAGASVVQIFGEVVFGDXAKNHSGEPEIDE

SEQ ID NO: 9508 - protein, 463 aa, Streptococcus pneumoniae TIGR4
MNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 9509 - protein, 458 aa, Glycine max
MAKHDDCGRMIDTKGGQSFEIEMKGSPATPTPAATQDSFKGGVKIQQSSNVQASFTLFKSFLGTGVLALPYAYKTAGLGLSLIVLIIVSAMTTRCFSLLLDVAAQRIGTGKISLQKLTQDVLGTKGKYAVQASIMIMQLGCCIGILIFTRDFLNHILCEFGISSLCNNTLFNVLFCLALTVPLTLINNMHYFYIPSLAANFFILVGLAAQMFYNTQVLQDNPELRSTLGTHLKEFNWKDLPLFFGIATYAFEGVGIIFSIRSSMEKPQDFKFLLKNQMLILTLIYVIFPTFCYIALDDRLTDIIFFTLPTDDPFYLLIQIFYAISALLSFPVQFFPAIRIMENSKIMRYRLFNERGKCNNKPLRYGMRMAVIGVVFLVAYTATSFHLFLNLLGSCVFTFVGFILPVWIYSVHFKGKTGIAKRLINYTMLTVAVVFGAAGFVMSIMEMVNKSSEDVATL

SEQ ID NO: 9510 - protein, 394 aa, Zea mays subsp. mays
LGAERRARLPLGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 9511 - protein, 474 aa, Shigella flexneri 2a str. 301
MQHKLLINGERVSGEGEKQPVYNPATGDVLLEIAEVSAEQVDAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 9512 - protein, 73 aa, Oryza sativa
  unsure (1)..(73): unsure at all Xaa locations
GVQSAGAAVAWQVGTHKASLISQLIVNWALTPVGYPLLALLVFXAVKEQDSSVSSVEDGKEKDSKLSAPTSFH

SEQ ID NO: 9513 - protein, 486 aa, Vicia faba var. minor
MVENISRTNLSYRGDTGGIEEAIDDAPLQTDSKFYDDDGRVKRTGTVWTTCSHIITGVIGSGVLSLAWSVAQMGWIAGPATMIFFSIITLYTSSFLADCYRSGDTEFGKRNYTFMDAVHNILGGPSVKICGVVQYLNLFGSAIGYNIAAAMSMMEIRKSYCVHSSHGEDPCHVSGNAYMIAFGVAQLFFSQIPDFHNTWWLSIVAAVMSFFYSTIALALGISKVAETGTVMGSLTGISIGTVTPAQKVWGVFQALGNIAFAYSYSFILLEIQDTIKSPPSEGKAMKKAAKLSIGVTTTFYLLCGCTGYAAFGDAAPGNLLAGFGVSKAYILVDMANAAIVVHLFGAYQVYAQPLFAFVEKEAGKKWPKIDKGFEVKIPGLPVYNQNIFMLVWRTIFVIVPTLIAMLIPFFNDVLGVIGALGFWPLTVYFPVEMYIIQKKIPKWSRKWICLEIMSTFCLFVSVVAGLGSLIGVWIDLKKYKPFSLEN

SEQ ID NO: 9514 - protein, 251 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 9515 - protein, 539 aa, Streptomyces parvulus
MKVFHALADALTAHGVDTVFGLMGNANLLYLPAFADAGGRFVAVAHEAGAVAMADGRARMCGGIGVASVTHGPAFTNALTPLVEAARSHSQVLLITGDPPPVPTHFHHFDIATVAAAAGAGYERVHRPASLVADLNRAVQRIVAERRPVVLNVPIDLMQAEAGEQAPVTLPVAPGPLAAPEAEALDGALGLIGSAKRPLVLAGHGAAVAGAREALVELADRTGAALATTVLGKEMFAGHPRDVGIFGSLAHSVASTVIAESDCVIAFGASLNMWTVLNGELLRGKRVVHVDTDPARFGSYSPVDEPVAGDARRTAETMNVLLDQAGVTAANGAWAERVAGQLAGFSPQDDVDDRSGAETVDIRTAMIRLDRILPAERSVVSDIGRFDVGVWPYLRVADPLHFTVMGGFGSIGLGVAGAIGAATAGTGRPVVAAVGDGGFMMHLSEFTTAVRYRLPLVVVVLNDGAYGAEHYKLRNHGYDPAYSAFAWPDLAGLATAMGARALTVRKAEELDAVGDLLSTLEGPLLVDVRLDPDVNLVRY

SEQ ID NO: 9516 - protein, 154 aa, Glycine max
KMFYFFFESRNSKKDPVVIWLTGGPGCSSELAVFYENGPFKIANNMSLVWNEYGWDKVSNLLYVDQPTGTGFSYSTDKRDIRHDEEGVSNDLYDFFITGESYAGHYIPAFAARVHRGNKAKEGIHINLKGFAIGNGLTDPGIQYKAYTDYALDM

SEQ ID NO: 9517 - protein, 125 aa, Thinopyrum intermedium
DLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRG

SEQ ID NO: 9518 - protein, 494 aa, Saccharomycopsis fibuligera
MQISKAALLASLAALVYAQPVTLFKRETNADKWRSQSIYQIVTDRFARTDGDTSASCNTEDRLYCGGSFQGIIKKLDYIKDMGFTAIWISPVVENIPDNTAYGYAYHGYWMKNIYKINENFGTADDLKSLAQELHDRDMLLMVDIVTNHYGSDGSGDSIDYSEYTPFNDQKYFHNYCLISNYDDQAQVQSCWEGDSSVALPDLRTEDSDVASVFNSWVKDFVGNYSIDGLRIDSAKHVDQGFFPDFVSASGVYSVGEVFQGDPAYTCPYQNYIPGVSNYPLYYPTTRFFKTTDSSSSELTQMISSVASSCSDPTLLTNFVENHDNERFASMTSDQSLISNAIAFVLLGDGIPVIYYGQEQGLSGKSDPNNREALWLSGYNKESDYYKLIAKANAARNAAVYQDSSYATSQLSVIFSNDHVIATKRGSVVSVFNNLGSSGSSDVTISNTGYSSGEDLVEVLTCSTVSGSSDLQVSIQGGQPQIFVPAKYASDICS

SEQ ID NO: 9519 - protein, 387 aa, Glycine max
  unsure (1)..(387): unsure at all Xaa locations
METGIACYTRGPFLPSVSSKHSPPSISPSFGLRSLKSSSLFGESLRVASKSTIKVSKTKNTSLVTRCEIGDSLEEFLTKATPDKGLIRLLVSMGEALRTISFKVKTASCGGTQCVNTFGDEQLAVDLLANQLLFEALXYSHFCKYACSEXXPELLDMXGSVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 9520 - protein, 191 aa, Shewanella oneidensis MR-1
MLLMIDNYDSFTFNLVQYFQQLGQEIVVKRNDEISLEGIEALAPSHLVISPGPCSPNEAGISLAAIEHFATRLPILGVCLGHQAMAQVFGAKVVRAQRVMHGKVSAIAHTGERLFKGLNQPLTVTRYHSLLVDTVPKDFVLDAWFDDPTHGREIMAMSHKELPLFGVQFHPESILTEQGHELLANFLSQST

SEQ ID NO: 9521 - protein, 214 aa, Oryza sativa (japonica cultivar-group)
MEGFSQEHVIGIPLASFAYAEEKIERKTSRSSLVHKKGKKNSIIYRMSKLSQKTDSYVQGFKEHITLGPKISDTLKGKLSLGAKVLQAGSIDKVFRQYFQVDKDEKLLKAFQCYLSTTAGPIAGMLFISTEKIAFHSDRPLDLTSPKGGITRVPYKVLIPAKRIKSAAVRENLYNPDEKYIDVVTVDGFDFWFMGFISHTKSFEYLQRVISEFR

SEQ ID NO: 9522 - protein, 289 aa, Glycine max
  unsure (1)..(289): unsure at all Xaa locations
MAKGKHSHTRAQGKKWSTFSLVLWALFFLTLILVVLLALGIVYLPTTDDDFPTTELSAFRRKTSQSGESLVENSEQWTEILSWEPRAFIYHNFLSKEECEYLIELAKPHMVKSSVVDSKTGKSTESRVRTSSGMFLKRGRDKIIQNIEKRIADFTFIPVXNGEGLQILHYEAGQKYEPHYDYFLDEFNTKNGGQRIATVLMYLSDVEEGGETVFPAANANFSSVPWWNDLSQCARKGLSVKPKMGDALLFWSMRPDATLDPSSLHGGXPVIKGNKWSSTKWLHLHEYKV

SEQ ID NO: 9523 - protein, 758 aa, Dechloromonas sp. RCB
MEKDLREAALEYHRWPTPGKISVRPTKGLTNQRDLALAYSPGVAAACDAIVEDPATAAWYTSRANLVGVVTNGTAVLGLGNIGPLASKPVMEGKGCLFKKFAGIDVFDIELAENDPDKLIDMIAALEPTLGGINLEDIKAPECFYIEEKLKARMNIPVFHDDQHGTAIISGAAMLNGLKVVGKKIDQVKVVVSGAGAAAISCVNLWCELGVKRENITICDSKGVIYVGRPGGMDETKARYAQNTDKRTLGEALVGADIFLGLSAAGVVKQDMVKAMADKPMVFALANPTPEIMPELVKEVRPDAIIATGRSDYVNQVNNVLCFPFIFRGALDVGATRITEEMKMASVRAIAELAEAEVTDEVAMAYPGADLSFGPEYLIPKPFDPRLIVKIAPAVAQAAMDSGVATRPITDWAAYRAKLSEFVYHTGVGMRAIFQAARQAKGKRIIFAEGEDERVLRAAQVVIEEKFARPILIGRPEVIAHRLEKAKLRIQPGVDFDVVNPESDERYRECWTAYHKAMARQGITPAIAKEAMRRKPTVIGAMLLKLGYADGMICGMTGQYSHHLGVISQIIGKRAGVSTLAAMNYLMLPGRSLFICDTHVNENPNAQEIAEMTLMAAEQVKRFGSHPKVALLSHSNFGSANSESARKMSIAAGLVSAMSAGELEVDGEMHGDSALNEDLRREANPDSPLKGEANLLVMPNIDAANISYNLIKMTGGEGVTIGPILLGAARPAHVLTSTATVRRLVNMTALAVVESMER

SEQ ID NO: 9524 - protein, 503 aa, Oryza sativa
  unsure (1)..(503): unsure at all Xaa locations
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFXCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 9525 - protein, 419 aa, Staphylococcus aureus subsp. aureus Mu50
MVVEKRNPIPVKEAIQRIVNQQSSMPAITVALEKSLNHILAEDIVATYDIPRFDKSPYDGFAIRSVDSQGASGQNRIEFKVIDHIGAGSVSDKLVGDHEAVRIMTGAQIPNGADAVVMFEQTIELEDTFTIRKPFSKNENISLKGEETKTGDVVLKKGQVINPGAIAVLATYGYAEVKVIKQPSVAVIATGSELLDVNDVLEDGKIRNSNGPMIRALAEKLGLEVGIYKTQKDDLDSGIQVVKEAMEKHDIVITTGGVSVGDFDYLPEIYKAVKAEVLFNKVAMRPGSVTTVAFADGKYLFGLSGNPSACFTGFELFVKPAVKHMCGALEVFPQIIKATLMEDFTKANPFTRFIRAKATLTSAGATVVPSGFNKSGAVVAIAHANCMVMLPGGSRGFKAGHTVDIILTESDAAEEELLL

SEQ ID NO: 9526 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXXXXXXXYAIANDRDSVTLVPKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 9527 - protein, 588 aa, Microbulbifer degradans 2-40
MKYDGHQRIKQVEKLSGGDMLIRALADEGVEYLFGYPGGAALHIYDAVFRQKRVQHILVRHEQAATHAADGYARSTGKVGTVLVTSGPGATNAITGIATAYMDSIPMVVISGQVASDKIGEDAFQETDMVGVSRPIVKHSFLVKHAKDIPEIVKKAFYIASTGRPGPVVIDIPKDITNPVDKFEYSYPDKVKIRSYTPAAKGHTGQIKKAVQLLLGARRPIIYAGGGVVQGNASNQLTEIAKLLNFPVTNTLMGLGAFPGTDKQFLGMLGMHGTVEANTAMHHADVIFAVGARFDDRVTNTPSKFCPSAKIIHIDIDPASISKTVTADVPIVGPVEGVLDEMLELVKATKERPDTSAIASWWKQIDEWRDRYSIIDTPRYDTGGMIKPQEVVRMVHEVTGGDAYVCSDVGQHQMFSAQYYQFDKPRRWINSGGLGTMGFGLPAAMGVQIAHRDANVVCVTGEGSIQMCIQELSTCTQYHLPVKIICINNQALGMVRQWQDMQYESRYSESLYEDSLPDFVKLMEAYGHVGMKVTKREELKSKLEECFAMKDKTVFMDIYVDPNEHVYPMQVAPNGSMRDMWLSKSERT

SEQ ID NO: 9528 - protein, 506 aa, Vibrio parahaemolyticus RIMD 2210633
MIYAQPGSENAIVNFKSHYDNFIGGEWVKPTGGEYFDNISPINGQAYCKVARSGEADINLALDAAHNIKAKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDIFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESISQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSIDPLGFF

SEQ ID NO: 9529 - protein, 170 aa, Zea mays; identical to SEQ ID NO: 2818

SEQ ID NO: 9530 - protein, 387 aa, Zea mays
NKVDPRLAVEQNGQNADASTNGASATTLEATQPVSPWGDVDHLLDGYDDQQKALIQKERARRITEQHKMFSARKLCLVLDLDHTLLNSAKFIEVEPIHEEMLRKKEEQDRTLPERHLYRFHHMNMWTKLRPGIWNFLQKASNLFELHLYTMGNKLYATEMAKVLDPTGTLFAGRVISRGDDGDPFDSDERVPKSKDLDGVLGMESAVVIIDDSVRVWPHNRHNLIVVERYTYFPCSRRQFGLPGPSLLEIDRDERPEDGTLASSLAVIERIHHNFFSHPNLNEADVRSILASEQRRILTGCRIVFSRVFPVGDASPHLHPLWQTAEQFGAVCTNLVDDRVTHIVANSPGTDKVNWALSKGKFVVHPGWVEASALLYRRANEHDFAVK

SEQ ID NO: 9531 - protein, 404 aa, Arabidopsis thaliana
  unsure (1)..(404): unsure at all Xaa locations
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNXAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 9532 - protein, 525 aa, Hordeum vulgare subsp. vulgare
  unsure (1)..(525): unsure at all Xaa locations
MDMDQLCLMAVATILLTLILRQVLGGKGTGAKLPPGPWNLPVIGSLHHLVATKPPPHRALLSLSRRYGPVMLLRLGEVPNVIVSTPEAAVLVLKTNDLTFATRTSGPTLDVVGSASEGIIFAPYGEHWRQMRKVCVVELLSAMQVRRIQSIMQAEIAHLLESVAAASSASPFRSAVVDVGKGLARLTNNVIARAVFGGKSRQQEAYLRELGVMAILGGGFSLVDLFPSSRLVRWLSSSGRAMRRLHSRMQRILGDIIQDRKETRAPNGASDAATARDNEDLLDVLLRLGKQDALSFXLTSEIISAVIFDIFSAATDTTAATLEWAMAELVXNPQAMARAKLEVRQMLRHRRSSTITSADLAGLHYLRMVIKETLRLHPSAPLIHRASQENCRVMGYDIPKGTAVMINAFAVGRDPAHWGADAAEFRPERFQGTSVEYSSQGPHMEFVPFGAGRRQCPGALFATTMLELVLANLLYHFDWAIPGGESPEAMDMGEVFGIIVHTRSSLHLQASEACHLQDQTTGVVS

SEQ ID NO: 9533 - protein, 561 aa, GIBBERELLA ZEAE PH-1
MADETVISEPQPSPAPRKGVWHLLLENPYIFGLSLFASLGGFLFGYDQGVLTMESFATKFPRIYLDSSFKGWFVSTLLLCAWFGSLVNGPIADFLGRKGSMLVAVVIFTIGSAFQAGASDIPMLFAGRAVAGFAVGMLTMIVPMYVSEVSTAGIRGTLVVLQQLSITLGILYIGGHRCAPDIPYSGGTKDKPTFDPRHDVGSGGCTGQSDAAWRVPFAIQIFPAIVLGLGMLLFPESPRFYLMRRKEDKALNALAQLRRVHPDTNSLRHEYLAIKAEVLFDEAVNRDKFSGKKGVSLFIAQHGALVSNWASFRRLAIGCCIMFFQQFMGCNAIIYYAPTMFAQLGLSGGTSGLLATGVYGIVNTLSTLPALFLIDKIGRRPLLMCGAAGTFISLVIVGGIIGGYGASLASNKSAGWAGIAFIYIYDINFSFSFAPIGWVLPAEIFNLGIRSKAMAITTSTTWMCNFIIGLVTPDMLSTIGWGTYIFFAAFCLLAFFFTYFFVPETRGKSLEEMDALFGDTAAYEEKARLMEIASEIGLTEAFPDSTIDLARKKPATAEHLA

SEQ ID NO: 9534 - protein, 200 aa, Zea mays; identical to SEQ ID NO: 7531

SEQ ID NO: 9535 - protein, 196 aa, Dechloromonas sp. RCB
MNEELVVGLVSISDRASTGVYEDKGIPALQEWLSSALTTPWRVETRLIADDQPTIERTLVELVDERQCHLVLTTGGTGPALRDVTPEATLAIADKEMPGFGEEMRRISLNFVPTAILSRQVAVIRKQALIINLPGQPKSIKETLEGVRDADGKVTHVGIFAAVPYCIDLIGGPYAETNEAVIKAFRPKSAIRAKQP

SEQ ID NO: 9536 - protein, 750 aa, Streptomyces avermitilis MA-4680
MAPRTNRPRTNRPRTGRPPAPDAPAAPDAPTAPDARRRRLPMRFLLPSLLLLAVMAMLMLRGFVHSEILADHRIRPPAATDQVPEKILDGGPVIDTRGGRTTSLSLPDHRLVLTFDDGPDPQWTPKVLDVLKKHHAHAVFFVTGTMTSRHPDLVRRLVAEGHEVGVHTFNHPDLAYQSKKRIDWELSQNQLALAGAAGIRTSLFRPPYSSFADAMDNESWPVTEYIGTRGYITVVNNTDSEDWQKPGVDEIIRRATPRGGKGAVVLMHDSGGDRHQTVQALDRFLPELQRRGYEFENLSEALGAPSAHTPVTGVDRWKGNAWIFLVQAADRITGMLVVGLAVIGGLVLTRFGLMLLLSGTHARRVRRPDFRWGPAPVTEPVSVLVPAYNEAKCIENTVRSLTASEHPVEVIVVDDGSSDGTARLVESLRLPDVRVVRQHNAGKPAALNRGLANARHDLIVMMDGDTVFEPATVRELVQPFADPRVGAVAGNAKVGNRDSLIGAWQHIEYVMGFNLDRRMYDLLRCMPTIPGAVGAFRRSALERVGGMSDDTLAEDTDITMALHRDGWRVVYAEKARAWTEAPESVQQLWSQRYRWSYGTMQAIWKHRRALVERGPSGRFGRVGLPLVALFMVVAPLLAPLIDVFLLYGVIFGPTQKTVLAWLGVLAVQAVCAAYAFRLDRERMTHLVSLPLQQILYRQLMYVVLLQSWITALVGGRLRWQKLRRTGVVEAPGSIPQQRTAGSESERRPVG

SEQ ID NO: 9537 - protein, 121 aa, Arachis hypogaea
DGITHVGGDMFVSVPKADAIYMKWILHDWSDQHCIKILKNCRKAIPENGKVIIVDHVLQPEGNDLFDDTGFAFDMMLLAHNAGGKERTEENWKWLFAETGFPRYNIIKIKALPSIIEAFPN

SEQ ID NO: 9538 - protein, 419 aa, Neisseria cinerea
FTVPARIVLKDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 9539 - protein, 177 aa, Glycine max
MGDKEEESAMPRDAKIVKSLLKSMGVEDYEPRVIHKFLELWYRYVVDVLTDAQVYSEHAGKPAIDCDDVKLAIQSKVNFSFSQPPPREVLLELAHNRNKIPLPKTIAGPCIPLPPDQDTLISPNFQFAIPNKRPAPPLEETEDEEATIPNPSQEQKVDTPPNPHQRVSFPLPKRQKD

SEQ ID NO: 9540 - protein, 174 aa, Glycine max
  unsure (1)..(174): unsure at all Xaa locations
MVPSVISSPAETTVNRAGAGMADPLTALKSMDGCPTXNTLIDFTSFASNGGRAQNMQAWPPVDNKKYETLYYLPDLDPAQPAKDGXYLLRTGWTPRLELELEHGFWCREHNRPPEHYDGRYWTMWKLPIMTYTDAYHASKDLXEANTAYPNGFIRIIRFNTVRQVHHMNLIDYK

SEQ ID NO: 9541 - protein, 352 aa, Xylella fastidiosa Temecula1
MNVMGFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSTFTYNSIDRRDGSITYGGYSDVIVVRDKFVLLLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTAPYDHDVNPYMPTLVLEGVLVLVGYMGPLSTPVNAGGVVRGRRAISGSFIGGVPETQQMLDFCGQHGIVSDVEIIPIQKINEAYERMLKSDVKYRFVIDMTSLTSSGA

SEQ ID NO: 9542 - protein, 107 aa, Clostridium thermocellum ATCC 27405
NQILTDGFYHADPHPGNIRVLADGTIVFLDLGMVGIINESRKKMISNFFIGVSTKNSKIVARSIVDLGEMSERRNLKRFEKDIDKMIDKYIAMPWSEIKVVDLFYEV

SEQ ID NO: 9543 - protein, 221 aa, Corynebacterium efficiens YS-314
MAQQRKPIIAPSILAADYARLGEEIAAVPDADWIHVDIMDGHFVPNLSFGYDVTRAVHRVTDKPLDVHLMIENPEKWVDHYIDAGAACVIFHVEATDKHVELAQHIRSKGVRAGFSLRPGTPIEDYLDDLEHFDEVIVMSVEPGFGGQSFMPDQLDKVRTLRRVIDERGLDIIIEIDGGISATTIEQAAEAGVDAYVAGSAVFGADEPNAAVQELRALASK

SEQ ID NO: 9544 - protein, 232 aa, Clostridium novyi
SRMSDPKMIKEIIDAVSIPVMAKVRIGHVVEAQILQAIGIDYIDESEVLTPADDLFHINKKEFNVPFVCGARNLGEALRRIGEGACMIRTKGEAGTGNVIEAVRHMRTIQSQIRKLKVMPKEELMIAAKELGAPYDLVEYVRENGKLPVINFAAGGIATPADAALMMQLGCDGVFVGSGIFKSENPAKRAKAIVEAVKNYNNPLKIAEVSEGLGEAMTGLEIDKLDVTFAER

SEQ ID NO: 9545 - protein, 357 aa, Solanum tuberosum
MALQIAKRLLRCRADSVASSVRFFDRTFTSESNSNLIRATLFPGDGIGPEIAESVRQIFKVAEVPIEWEEHYVGTEVDPRTNSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEIKYEEVVIDNCCMMLVKNPALFDVLVMPNLYGDIISDLCAGLIGGLGLTPSCNIGEGGIALAEAVHGSAPDIAGKNLANPTALLLSSVSMLRHLELHDKADRIQDAILKTIAGGKVPNWRPWRHCYNN

SEQ ID NO: 9546 - protein, 302 aa, GIBBERELLA ZEAE PH-1
MVLYNGFDSITDVPDLLGKVILVTGGTSGLGRSAITTLAAHNPSHIYFTGRSSSAAESLIKDISPIPSTFLECDLTSIANMHAAAKKFRHDRLDLFIANAGVMAVDGLTKDRLELQFGVNHVGNATLFMALLPIMLKTAEEPNSDVRFVSLTSLGYRGHPKNGIEFDTLQSKQEDMSFGTWGRYGQSKLANIVFAKEIQRRHPKITSVVVHPGVIATGLVTELSFWKRMFVYVTNPRMMTVEQGGLNTVWAATSGDVKKGDEKVAFYEPVGKGNAGDEMCFSQELGKKLWEWTEEKINSTKM

SEQ ID NO: 9547 - protein, 468 aa, Escherichia coli CFT073
MEGIMPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 9548 - protein, 390 aa, Oryza sativa
  unsure (1)..(390): unsure at all Xaa locations
FFTDAYDLFCIALVTKLLGRLYYTDITKPNPGTLPPNVSSAVTGVALCGTLAGQLFFGWLGDKLGRKSVYGFTLILMVVCSIASGLSFGSTPKSVITTLCFFRFWLGFGIGGDYPLSATIMSEYASKKTRGAFIAAVFAMQGFEILFGAIVALVVSAGFRHAYPAPSYTQNPAASLAPQADYTWRLILMFGTIPAGLTYYWRMKMPETARYTALVARNAKQAAADMSRVLHAEIEERPEVVESQVVAGETWDLFSRQFMKRHGMHLLATTSTWFLLDIAFYSQNLFQKDIFSKVGWIPPAKTMNALEELYRISRAQALIALCGTIPGYWFTVAFIDIVGRFXIQIMGFFMMTVFMLALGVPYDHWTHPAHHTGFVVLYALTFFFAXLGPN

SEQ ID NO: 9549 - protein, 388 aa, Mycobacterium tuberculosis H37Rv
MTDRVALRAGVPPFYVMDVWLAAAERQRTHGDLVNLSAGQPSAGAPEPVRAAAAAALHLNQLGYSVALGIPELRDAIAADYQRRHGITVEPDAVVITTGSSGGFLLAFLACFDAGDRVAMASPGYPCYRNILSALGCEVVEIPCGPQTRFQPTAQMLAEIDPPLRGVVVASPANPTGTVIPPEELAAIASWCDASDVRLISDEVYHGLVYQGAPQTSCAWQTSRNAVVVNSFSKYYAMTGWRLGWLLVPTVLRRAVDCLTGNFTICPPVLSQIAAVSAFTPEATAEADGNLASYAINRSLLLDGLRRIGIDRLAPTDGAFYVYADVSDFTSDSLAFCSKLLADTGVAIAPGIDFDTARGGSFVRISFAGPSGDIEEALRRIGSWLPSQ

SEQ ID NO: 9550 - protein, 787 aa, Triticum sp.
MTTDQPVISLRPGGGGGGPRGGRLFAPAFAVAASGSGDFLRPHGGGAFRALQDWCLHLSHERVRYSRDQLLDLRKITDVTEQILRLQQEIEAELNGDDQSWVRNDSNVQLQTQAQPQVQAQNRFTETDNRDWRARTEKPPAPAVQEEKSWDNIREVKEQYNASGRQQEQFNRQDQSSSQKAQVGPPPALIKADVPWSARRRNLSEKDRVLKTVKGILNKLTPEKFDLLKGQLLDSGITTADILKDVISLIFEKAVFEPTFCPMYAQLCSELNDNLPTFPSEEPGGKEITFKRVLLNNCQEAFEGADSLRVEIASLTGPDQEMEKRDKERIFKLRTLGNIRLIGELLKQKMVPEKIVHHIVKELLGSDKKACPDEEHVEAICQFFNTIGKQLDENPKSRRINDTYFVQIRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRARSMPRGDPLRNQGPLINKVPSINKPSPINPRLLPQGTGALIGKSALLGTGGPPSRPSSLTASPTPLPAQTTASPKPSSATPASVPIPDKAASSAKVIPAGLQKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVVARLILSCGLRFEAAEGILKAMEDTFFRKAIFTSVTKTLGADPAGQAILSSHAAVVDACNSLSI

SEQ ID NO: 9551 - protein, 365 aa, Candida glabrata
MAVTKTIVVPPGDHVGQEITEEANKVLNAIQECRPDKVNFKFDHHLIGGAPIDATGVPLPDEALEASKKADAVLLGAVGGPKWGTGAVRPEQGLLKIRKELQLYANLRPCNFASDSLLDLSPLKPEIARGTDFVVVRELVGGIYFGERKEDEGDGVAWDSEKYSVPEVQRITRMAAFMALQHNPPLPIWSLDKANVLASSRLWRKTVEETIKNEFPQLTVQHQLIDSAAMILVKNPTHLNGIIITNNMFGDIISDEASVIPGSLGLLPSASLASLPDKNTAFGLYEPCHGSAPDLPKGKVNPVATILSAAMMLKLSLDLFEEGEIIEQAVKKVLDSGIRTADLKGTNSTTEVGDAVAKAVRELLA

SEQ ID NO: 9552 - protein, 255 aa, ASPERGILLUS NIDULANS FGSC A4
MSRRYDSRTTIFSPEGRLYQVEYALEAISHAGTALGILAKDGIVLAAEKKVTSKLLEQDTSAEKLYTLNDNMICAVAGMTADANILINYARQAAQRYLITYGEEIPCEQLVRRLCDLKQGYTQHGGLRPFGVSFIYAGYDHLREFQLYQSNPSGNYGGWKATSVGANNASAQSLLKQDYKEDCDLKEACAMAVKVLSKTMDSTKLSSEKIEFATVGKTKEGKIYHHLWNADEINALLKEHGLAKVDDEPEAGDIK

SEQ ID NO: 9553 - protein, 407 aa, Triticum aestivum
  unsure (1)..(407): unsure at all Xaa locations
MAFCSPHTTTSLRSPCTTIPNSGFRQNQVIFFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEXVKFAWKIQRDMAERGHKXLESIKASIETRKXLDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9554 - protein, 488 aa, Porphyra haitanensis
MSQSVESRTRIKSERYESGVIPYAKMGYWDADYVIKETDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWKERFLYSMEGVNKASAAAGEIKGHYLNVTAATMEDMYERAEFSKEVGSIICMIDLVIGYTAIQTMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 9555 - protein, 465 aa, Streptococcus mutans UA159
MSHQNAKNTTQNPKELENGMVRGLQNRHVQLIAIAGTIGTGLFLGAGRSISLTGPSIIIVYLLTGLFMFWMMRAMGEMLYHDPDQHTFINFITKYIGKEWGYFAGWSYWVSVIFLGMAEITAIAKYVQYWFPSWPAWIIQIVFLLILGSVNLIAVRVFGEAEFWFAMIKIIAILALIATAIFMLLTGFKTSQGPVSFANISKGFEMFPNGWMKFLMSFQMVFFAYQAIEFVGITVSETQNPRKVLPKAIQEIPMRIVIFYVGALIAIMTIFPWRALPSDTSPFVMVFKLAGIKWAAALINFVVLTSAASALNSTLYSTGRHLYQLANEAPNQFMKRFKIGTLSKTGVPSKAIIFSAIVIAISAFINVLPGIKDAFALITASSSGVYIAIYVLTMLAHLKYRKSNDFMADGYLMPHYKILNPITIIFMVFVFITLFLQDSTYIGAIGATIWIAAFGFYSKFKFKKQ

SEQ ID NO: 9556 - protein, 119 aa, Glycine max
LRGHAVASWTWDAQDETCGICRMAFEGCCPDCKLPGEDCPLIWGVCNHAFHLPCILKWVNFQTSQGHCPMCRREWPFKGRELRFSFSFSRGPQEPRKMGRVNPKRNGSLQVKPDFPWNL

SEQ ID NO: 9557 - protein, 359 aa, Lycopersicon esculentum
MVFPLDSQLQNPISALLDGLYCEEDRFLDDDLGEWSSLDVGNENVKKTLPLLECDMFWEHDELATLLSKENEFHLGFQSLISDGSLMGARKEALDWMLRVIAYYGFTATTAVLAVNYFDRFVSGWCFQKDKPWMSQLAAVACLSIAAKVEETQVPLLLDLQVADSRFVFEAKTIQRMELLVLSTLKWKMNLVTPLSFIDHIMRRFGFMSNLHMDFLKKCERLILDIITDSRLLHYPPSVIATASMFYVINDIEPSNAMEYQNQLMSVLKVRKDIFEECHDLILELMDTACYKLCQSLKRKHHSVPGSPSGVIDAYFSSESSNESWSVASSISSSPEPQYKRNKTQDQRMTLAPLGSNLH

SEQ ID NO: 9558 - protein, 335 aa, Oryza sativa (japonica cultivar-group)
MPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 9559 - protein, 416 aa, Oryza sativa
MESEMADAAPAPAVAAAATAEPLAAVAEEGEEGGEAAVGSTLTMERVAAAKKFIENHYRSQMKNIQERKERFSVEKCAVNVVWMRRLCLSLSAVDNTLVAYHLFVLSGWSASRRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRK

SEQ ID NO: 9560 - protein, 445 aa, Xylella fastidiosa Ann-1
MVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 9561 - protein, 459 aa, Gracilariopsis sjoestedtii
DPDYVIKDTDVLALFRVTPQPGVDPVEASAAVAGESSTATWTVVWTDLLTACDLYRAKAYKVESVPNTTDQYFAFISYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAVAASGEVKGHYMNVTAATMEDMYERAEFAKQLGSIIIMIDLVIGYTAIQTMAIWARKNDMILHLHRAGNSTYSRQKSHGMNFRVICKWMRMAGVDHIHAGTVVGKLEGDPLMIKGFYNTLLETNLEVNLPQGIFFEQDWASLRKVTPVASGGIHCGQMHQLLDYLGNDVVLQFGGGTIGHPDGIQAGATANRVALESMVMARNEGKEYVAEGPEILRDAAKTCGPLQTALDLWKDITFNYTSTDTADFVETPTANV

SEQ ID NO: 9562 - protein, 425 aa, Ralstonia metallidurans
MSKVAEIRGLEVLDSRGNPTVEVEVVLDDGAVGRAIVPSGASTGAREAVELRDADPRRYLGRGVLRAVQAVNTELCEALLGRDAGDQPEIDTIMIDLDGTPDKRRLGANALLGVSLAVAHAAAMSNGLPLFAYLGGERASLLPVPLINVINGGAHADNALDFQEFMIVPAGAPTFTEAVRASAEVFHTLRAMLKAAGYTTNVGDEGGFAPEFHAAEEALDILVAAIAKAGYRPGEDIALAIDPAASELYVNGSYVYQGEGVERSREEQVAYLVRLADRYPIVSIEDGMAEDDAMGWQLLTRQLGKRCQLVGDDVFCTHPTLLRQGVEQGMANAILVKANQIGTLSEMRETVRVAHGYAYSAVMSHRSGETEDVTIADLAVALRCGQIKTGSMSRADRTAKYNRLLRIERELGSRAEYAGALLRRR

SEQ ID NO: 9563 - protein, 467 aa, Bacillus anthracis str. A2012
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITVLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAIWLIVGLCFYFFYSRKHSHLATEKTNDEQKKA

SEQ ID NO: 9564 - protein, 231 aa, Triticum aestivum
  unsure (1)..(231): unsure at all Xaa locations
MHPLRRKVSRTLRLISSLFFVYSLDYARTRLANDXKASKGGGERXFNGLVDVYRKTLKSDGIAGLYRGFNISCVGIIVYRGLYFGLYDSLKPVLLTGTLQVCSSTLPYTLLSSNFSCLRDNHXHPCSPFTCLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 9565 - protein, 839 aa, Pyrococcus furiosus DSM 3638
MVKVENSIKKKIEKKLPENLKKLAELAYNYWWSWDDKAMKLWQRIDEDHWREYKNPVKLLLDVPESRLKELSRDDTFLDLYELVIERFNSYLNPETTWFSTNYPKWDKPIVYLCMEYGISKSLPIYSGGLGILAGDHLKTASDLGLPLIGIGLLYKHGYFKQEIDKNGRQIEIFPEYNISEMPIRQVLNEDGSPLLIDVPMENRIVKARVFLVKVGRVDLYLLDTDVPENNEEDRKICDYLYNAEPDKRIKQEILLGIGGMRLLKALGIEPGVIHLNEGHPAFANFERIRWLMDEGLSFEEALEVVRGTSVFTTHTPVPAGHDVFPADFVREKLAKFFEGLPAEKFLDLGRRFPGDSNFNMTVLSIKTSNFVNGVSKLHAKITREMWADLWKGVPIDEIPIEGITNGVHTATWVHESIAKLYDIYLGKIWREHINLEGIWYAIERIPDEELWEAHLKAKREFIDLVRRKIMRRNERLGIEEPLPDIDENALIIGFARRFATYKRAVLLFTDLERLKRIVNNPERPVYIVFGGKAHPRDEAGKEFLRRVYEVSQMPEFKGKIILIENYDMGSARLFVSGVDVWLNTPRRPLEASGTSGMKAGLNGVINLSVYDGWWVEGYNGRNGWVVGDTTTEPESEEDDYWDAMSLYDLLENVVIPMYYENREAWIRMMKESIKSIAPNFSTHRMLKEYITKFYSKAIELGIFLSRDDYRWAKEIAKWKEKIAREWENVNIEDVKVNKHVIEAIVNLGDLTPEDVRLEIYYGLVDGEQGLINANTVELRPVKALGNGKYIYKYEGRALERLQEPCWMYKLRIYAHHPMLPTKFLLGGYIKWKDIEKKE

SEQ ID NO: 9566 - protein, 251 aa, Lactobacillus gasseri
MRTPIIAGNWKLHMNPEQTVEFVNAVKGKLPDPSKVESVIAAPAVDLYVLKKAAEGSDLHTGAENAYFEVEGAFTGETSPKVLNEMGIDYCIIGHSERRGYFHETDEDINKKAKALFANGVTPIICCGESLETREANKQEDWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 9567 - protein, 575 aa, Guillardia theta
MPNILKNRDTTGAFALIDSLVRHGVKHIFGYPGGAILPIYDELYAWEKEGFIEHILVRHEQGAAHASDGYARSTGNVGVCFATSGPGATNLVTGIATAHMDSVPMVIITGQVGRSFIGTDAFQEVDIFGITLPIVKHSYVVRETKEMGKIVAESFFIAKYGRPGPVLIDIPKDVGLEKFDYQIVNPNNINLAGCPVLKNYDQNRISQAANLIKQSSQPLLYIGGGAVTSNSHNEINELINLVKIPVATTLMGKGIIDESHPLSLGMLGMHGTVYANYAVSECDLLIALGARFDDRVTGKLDEFACHAQVIHVDIDPAEIGKNRTPQIGIVGEIKDFVRDLIECLKNDINFDSEQSQAWRSRIIRWRKEYPLLVPKNINNLSPQEVIHEISTEATNAYFTTDVGQHQMWAAQFIKTSQKRWITSAGLGTMGYGLPAAIGVQIAHPNEQVICISGDASFQMNIQELGTVSQYGLPIKIFIINNKWQGMVRQWQQAFYGERYSHSNMEKGAPNFTKVAEAFGLRSLKIKSRNDLKLRIKEALDYDGPILVDIQVIADENCYPMVAPGKSNAQMMGINS

SEQ ID NO: 9568 - protein, 351 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADLIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 9569 - protein, 183 aa, Mesembryanthemum crystallinum
MASSLMSNAATTMAAATTTAQANMVAPFNGLKSISAFPVTRKNNDITSVASNGGRVQCMQVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 9570 - protein, 336 aa, Streptococcus agalactiae 2603V/R
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVATLEKDVTVEEVNAAMKAAANDSYGYTEDPIVSSDIVGISYGSLFDATQTKVQTVDGNQLVKVVSWYDNEMSYTSQLVRTLEYFAKIAK

SEQ ID NO: 9571 - protein, 168 aa, Avena agadiriana
VMASSATTVAPFQGLKSTAGLPVSRRSSGSLGSVSNGGRIRCMQVWPIEGIKKFETLSYLPPLSEEALLKQIEFLIRSKWVPCLEFSKVGFIFREHGSTPGYYDGRYWTMWKLPMFGCTDASQVIKEVEEVKKEYPDAYVRIIGLDNIRQVQCVSFIAFKPPGCEESG

SEQ ID NO: 9572 - protein, 334 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARTAWC

SEQ ID NO: 9573 - protein, 217 aa, Helicobacter pylori 26695
MKVAPSLLSADFMHLAKEIESVSNADFLHVDVMDGHYVPNLTMGPVVLENVTQMSQVPLDVHLMVENASFFAELFAPLKPQIISIHAENEKHPHRVLQLIKNLGITPGIVLNPHTHEESIKYLLESVGLVLLMSVNPGFGGQKFLDLVLEKCLKVKELIKRYNPSCLLEVDGGVNDKNIFELQQAGVDVVVSGSYIFKSKDRKLAIEGLQNVRQSLA

SEQ ID NO: 9574 - protein, 290 aa, Glycine max
MAKPRYSRLPPRKSSSSSTLILTLFLVFTFLVLILLALGILSIPSSSRGNLPKPNDLASIARNTIHTSDDDDVRGEQWVEVVSWEPRAFVYHNFLTKEECEYLIDIAKPNMHKSSVVDSETGKSKDSRVRTSSGTFLARGRDKIVRDIEKRIAHYSFIPVEHGEGLQVLHYEVGQKYEPHYDYFLDDFNTKNGGQRIATVLMYLTDVEEGGETVFPAAKGNFSSVPWWNELSECGKKGLSIKPKRGDALLFWSMKPDATLDPSSLHGGCPVIKGNKWSSTKWMRVSEYKA

SEQ ID NO: 9575 - protein, 256 aa, Triticum aestivum
MPVARGAKKPGPVDSDSDDDGLVSKKPTKSSTYSVPTGNKKQYKDGFKDSGGLENQSVEELENYAAYKAEETTDTLNGCLRIAENIKEDATNTMITLQKQGEQISRTHEKAVEIDQDLTKGEGLLNSLGGFFSKPWKPKKTKKIKGPVSRDDSFKKKTSRMEQRDKLGLSPRGKGNTREYGEATSAMDKVQLEKKKQDDALDDLSGVLGQLQGMAVDMGSELDRQNKALDDMHGDVEELNSRVKQANQRARKILAD

SEQ ID NO: 9576 - protein, 488 aa, Zea mays
QACFPFAVLQLGYNQLTGSIPTQLGHLNKLTVLALQSNQLSGAIPASLGDLPALARLDLSSNQLFGSIPSKLAEIPRLATLDLRNNTLSGSVPSGLKKLNEGFLYENNPELCGAQFDSLKACPNDGNDDGRTPRKPESTSVIKPQQIQKAADLNRNCGDDGGCLKPSTLPTGAVVAGTFVIVAGAAACGLSAFSWHRRQKQKIGSSSVEHLEGRPSLDRSKEAYERSAVSSLINVEYSSGGWDTSSEGSQSQHGVARLSSAAECGSPSVRFNLEEVECATQYFSDVNLLGKSSFAATYKGVMRDGTAVAVKSISKNSCKSEEADFLRGLRTLTSLRHENLVGLRGFCRSRASGGCFLVYEFMANGSLSWYLDAKEGDAADAAAVLDWPTRVSIIKGVAKGIEYLHSSKPSLAHQSISADKVLLDHLYAPRLSGAGLHRLLADDVVFAALKDSAAMGYLAPEYATTGRSTDKQGDVYAFGVVVLQGATL

SEQ ID NO: 9577 - protein, 273 aa, Oryza sativa
FTRSNPSKLEIPGIKLGEDEDVTEEAVLTSLKRAIRRYSTLQAHDGHWPGDYAGPMFLLPGLVIVLHVTGALNTVLSTEHQKEIRRYLYNHQNEDGGWGLHIEGTSTMFCTVLTYVTLRLLGDESDGGDGAMVIARNWILDHGGATFTTSWGKSWLSVLGVFDWSGNNPLLPELWMLPYFLPFHPVRIWSPSRMVYLPMSYICGKKFVGPITPIVLTVRKELYNIPYDDINWDKARNQCAKEDLYYRHPLGQDILWATLYKFVEPVLSHWPGS

SEQ ID NO: 9578 - protein, 302 aa, Oryza sativa (japonica cultivar-group)
MVLVVPEGSHAVRLGNEASIRQRLAGAARGARYALTFSAARTCAQAERLNVSASGQWAVLPMQTMYSSNGWDSYAWAWDAAADAFDVVIHNPGVTEDPACGPLIDSVAIRTLNPPRRTNKNLVKNGDFEEGPYIIPGTRWGVLIPSMVVDEHSPLPGWMVESLKAVKYIDSDHFAVPRGRRAVELLAGRESAIAQVIRTVPGRQYALSFTVGDASNGCEGSLVVEAYAGRESTRVAHESAGRGGAAKRAVLPFRAAAARTRVVFFSSFYSTRSDDMSSLCGPVIDDVAVVSVRARRPAAKRG

SEQ ID NO: 9579 - protein, 270 aa, Lactococcus lactis subsp. cremoris
MTKKIVTLAGDGIGPEIMSAGLRVLKAVSKKIAFEYELVAKDFGGIAIDKHGHPLPEETLQAVKNADAILLAAIGHPKYNDAKVRPEQGLLALRKELGLYANVRPLKIYPALKNLSPIRNVENVDFVVIRELTGGIYFGQHELSDEKARDINDYTADEIRRILHFAFKIAQNRPRKLLTSVDKQNVLATSKLWRKIADEIAVEYPDVTLEHQLVDSCAMLLITEPQKFDVIVTENLFGDILSDEASSLAGTLALCPLVLMDLTDCHYMSQ

SEQ ID NO: 9580 - protein, 120 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 9581 - protein, 192 aa, Zea mays
  unsure (1)..(192): unsure at all Xaa locations
IDVAATDFCTGKKYDLEFKSTKKXGQNFKTADDMIEIYSQLCSEYPLVSIEQPFDKDDWEHSKKXTTLELCQVAGDDLLMSDPERIKRAVNEYTCNALVLKANQVGTVTEAIEVVKQAKDAHWGVMVSHRSGDTEDSFIADLAVGASAGQIKAGAPCRGECLTNYNQLLRIEGELGSEGVYAGENWRTVNTS

SEQ ID NO: 9582 - protein, 483 aa, Melanthalia obtusata
KERTRIKNERYESGVIPYAKMGYWDPDHIIKDTDVLALFRVTPQPGVNPVEASAAIAGESSTATWTVVWTDLLTACDLYRAKAYKVDSVPNAPDQYFAYIAYDLDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEGVNRATAASGEIKGHYMNVTAATMENMYERAEFAKQLGTIIVMIDLVVGYTAIQSMAIWARKNDMILHLHRAGNSTYSRQKSHGMNFRVICKWMRMAGVDHIHAGTVVGKLEGDPLMIRGFYNTLLLSHLDINLPQGIFFEQDWASLRKVTPVASGGIHCGQMHQLLDYLGNDVVLQFGGGTIGHPDGIQAGATANRVALEAMVIARNEGRNYVQEGPQILQNAAKTCGPLQTALDLWKDITFNYTSTDTADFVETPTANV

SEQ ID NO: 9583 - protein, 115 aa, Oryza sativa
MQVGGTAAAAAEVSMSYRETRREEEKRRGTKMKVKILQWHGVASWTWNAQDETCGICRMAFDGCCPDCKFPGDDCPLIWGSCNHAFHLHCILKWVNSQTSTPLCPMCRREWQFKG

SEQ ID NO: 9584 - protein, 125 aa, Triticum aestivum
  unsure (1)..(125): unsure at all Xaa locations
MAPTVMASSATSVAPFQGLKSTAGLPVSRRSNGASLGSVSNGGRIRCMQVWPIEGIKKFETLSYLPPLXTEGLLKQVDYLIRSXKWVPCLXFNKVGFIFREXNASPGXYDGRVGNVGKLNVSGGT

SEQ ID NO: 9585 - protein, 529 aa, Zea mays; identical to SEQ ID NO: 6022

SEQ ID NO: 9586 - protein, 812 aa, Eremothecium gossypii
MTLAKQGRMKNFGHGVGYQSFEQTVHCRLHTPLEVMKPTKNFYNDFTSVDWVQDYLRNIRYKQRLRSLPGLKGYVLRVSDGVKDWLLIVTVALVSSAIAYAIDVSEQLLVDLKRGYCEGNVVYNEQQCCVAFGCENWRLWSEVFSCNETTRLRGDFVIYIVLSLLLALLAVLITLTTRNETPEGSRTSETAPRAIYCAYGSGVPEVKTILSGFTIRRFLGSYTLLSKSTALVFAIASGLSLGKEGPYVHLATCVGNICSRMFKKFKNDGIERRVILSASAAVGVTLAFGSPLGGVLFSFEEVSYYLPGNQLFKTFFAAITSHLFLIILNPYGTGKAVLFEVSYQSNWRYLEIVLYVLIGAAGGVYGALFNKFVNFWADWFRKKHHMKAYPINEVLLVSLVTALLTFFNPYTNIAVPELLANIAAPCYSKDDFTGDHGLCPKDISIFPKELYPLVYALGVKIVLTSLTFGIKVPAGIYVPSMVIGALFGRIFAMYFQYYAYHYQQYFIFNRICPSLTEDGICVDLGIYAMISAGAFMAGVTRMNITLVTIMFELTSSYNHVVPISIAVAVSLFVANIIEPKALYEMLILKNDFPYLNKCRSHDFSEGEFGLPELITRLDTTGTSHLARIDVSKDNYVSAELLRNTANFVRSGDLIDGSIPVIRHGKLISMLPIPELDLALDELEVFISSAHIRDIHIKVADIEDRTFRFADDDGLNVTPDILAPQYDEQRSETELPLLISADVIIGTLNALSDLRPIIDTTPIMLDIRSPLSLVEYVFMRLGNRTIAIIDNGVLVGILHKKHFIDKCRNRRLL

SEQ ID NO: 9587 - protein, 302 aa, Pseudomonas aeruginosa
MFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 9588 - protein, 356 aa, Ustilago maydis
MGACLSAEQSHDTPEYKRSKALDRRIKEDEKNLSREVKLLLLGAGESGKSTILKSMRIIHHIPFTDEERENFRRLVFLNLVQGMKTILDVMEEWSIDFQDDSNIDHLLLFVSYPDISEDEPFPTNYLVALKDLWLDQGVQSVYRRGNEAAVPDNMSYYYTDLDRLFSPSYIPSEDDILRCRNKTTGIIETTFPLQDHVYRIFDVGGQRSERKKWIHCFENVTAVLFCVALSGYDSCLVEDKDSNQMQEALMLFDSICNSKWFARTSMILFLNKVDVFRQKIAYSSIKHYFPDYDGDDQDFNAARSYFKARFCRLNRSVNKEIYPSFTNATDVSLLKIVMASVTDIILTNNLRDIVL

SEQ ID NO: 9589 - protein, 361 aa, Lolium perenne
MGSTAAEIAASADEEACLYALQLGSSSILPMTLKNTIELGLLETLMAAGGKSLTPTEVAAKLPCAAKNPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLQLYDGFQGLGTLVDVGGGVGATVAAITAHYPTIKGINFDLPHVISEAPPFPGVTHVGGDMFKKVPLGDAILMKWILHDWSDQHCGTLLKNCYDALPMHGKVVLVECILPVNPEAKPSSQGVFHVDMIMLAHNPGGRERYEREYEALARGAGFAGFKSTYIYANAWAIEFTK

SEQ ID NO: 9590 - protein, 459 aa, Imantonia rotunda
DPDYAIKETDLLALFRCTPQPGVDPVEAAAALAGESSTATWTVVWTDLLTACDLYRAKAYRVDPVPSTPDTYFCYIAYDIDLFEEGSLANLTASIIGNIFGFKAVKALRLEDMRFPYALLKTFQGPATGLVVERERMDKFGRPLLGATVKPKLGLSGKNYGRVVFEGLKGGLDFLKDDENINSQPFMRYRERFLYSMEGVNNAAAHSGEVKGHYLNTTGATMEDMYERANFAKDLGSIIVMIDLVIGYTAIQSMSHWARDNDVILHLHRAGNSTYSRQKNHGMNFRVICKWMRMAGCDHIHAGTVVGKLEGDPLMIKGFYNTLLNCKTDVNLPEGLFFAQDWASLRKCVPVASGGIHCGQMHQLINYLGDDVVLQFGGGTIGHPDGIQAGATANRVALECMVLARNEGRDYIAEGPQILRDAAKTCGPLQTALDLWKDITFNYASTDTADFVETPTANV

SEQ ID NO: 9591 - protein, 365 aa, Eremothecium gossypii
MPRTITFDIPSHYKLVDLIGEGAYGIVCSAIHKPTGTKVAIKKIQPFTRPMFVTRTLRELKLLKFFHSHENIISVLDIVRPTSYQDFEAVYLVQELMETDLQRIISQPNSFLSDDHIQYFTYQILRALKSLHSAQVIHRDLKPSNLLLNSSCDLKLCDFGLSRCLASSDRSRENMVGFMTEYVATRWYRAPEIMLSFQEYTTAMDIWSCGCILAEMISGKPLFPGRDYHHQLWIILEILGTPSFEDFEQIKSKRAKAYIANLPMRPKIPWNVALSTNDINPLAMDLLDKMLTFNPDKRISAADALKHPYLETYHDAEDEPDYELLNLQDNFWKVDNEARQKTEEEELSMDTLKAMLYEEVMKPLQ

SEQ ID NO: 9592 - protein, 153 aa, Yersinia enterocolitica
KGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHH

SEQ ID NO: 9593 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 9594 - protein, 355 aa, Agrobacterium tumefaciens str. C58
MFTTSAYACDDGSSPMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSLPRQKAA

SEQ ID NO: 9595 - protein, 411 aa, Escherichia coli CFT073
MEFTTGLMSLDTALNEMLSRVTPLTAQETLPLVQCFGRILASDVVSPLDVPGFDNSAMDGYAVRLADIASGQPLPVAGKSFAGQPYHGEWPAGTCIRIMTGAPVPEGCEAVVMQEQTEQTDNGVRFTAEARSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERDRGNVEVGEWVEVEPFNALFGGL

SEQ ID NO: 9596 - protein, 310 aa, Zea mays
  unsure (1)..(310): unsure at all Xaa locations
MDHAADAHRTDLMTITRHVLNEQSRNPEPRGDFTILLSHIVLGCKFVASAVNKAGLAQLIGLAGETNVQASALSSLFFSFLRRDXSRCDDAAAMVARRARQGEEQKKLDVLSNEVFVKALVSSGRTCVLVSEEDEEHVRDPXLRGGDRLXCELVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERXPIFLGSYDDVEEIKALYAEQAKSSSASS

SEQ ID NO: 9597 - protein, 90 aa, Haloferax denitrificans
  unsure (1)..(90): unsure at all Xaa locations
CIGCQTCTVACKSLWTEGGGRDYMYWNNVETKPGKGYPRDWEDSGGGWKDAEHTERKPGDIPEQADYGDAWSFNHEEVMYNGGVQPLXPT

SEQ ID NO: 9598 - protein, 243 aa, Prochlorococcus marinus subsp. marinus str. CCMP1375
MRKTVIAGNWKMHMTCSSAKEYIDKFIPFSKEFPSDRHVVIAPPFTAISTLASLLQGTNIQLSSQNVHWEDTGAFTAEISPSMLLEHDVRYAIVGHSEPRKYFSESDEQINLRARSAQSNGLIPIVCVGESIEQRERGEAERVIRRQVEQGLEQTDLTKLVIAYEPIWAIGTGKTCESNEANRICGLIREWAGFSDLIIQYGGSVKPANIDEIMSMSDIDGVLVGGASLDPENFARIANYQSI

SEQ ID NO: 9599 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMXVDDIPRIVQEAFFLATSGRPGPVLVDVPKDIQQQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYSVEHSDLLLAFGVRFDDRVTGKLEAFASRAKIVHIDIDSAEIGKNKTPHVSVCGDVKLALQGMNEILENRAEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGXGRTKY

SEQ ID NO: 9600 - protein, 248 aa, Photobacterium profundum
MLEVTFSLASGAASAYNNAVNFSPRHVVLQVLSDMSENSHQCVIIGIAGASASGKSLIASTVYKELKEKVGDHQIGVITEDCYYNNQSHLTMDERVKTNYDHPNALDHNLLCDHLQRLIEGKAVEVPQYSYSEHTRLKETTPMTPKKVIILEGILLLTDPRLRELMHASVFMDTPLDICLLRRLQRDVAERGRTMESVLVQYQKTVRPMFMQFIEPSKQYADIIVPRGGKNRIAIDVLKAHIAKLLKS

SEQ ID NO: 9601 - protein, 867 aa, Piromyces sp. E2
MKIQNILVALTCGLVSQVFATSWSEADEKAKSFMSDLSESEKIDIVTGYMNMQGTCVGNIKPLDRKNFKGLCLQDGPAGVRFNGGTSTTWQAGINNAATFNKDLLYKIGKDQGAEFYAKGINIALAPSMNILRAPASGRVWENFGEDPYLSGVCGAQITKGYQDSGVIVAAKHYVANDIEHNREASSSNMDDQTLMEIHVEPFYRTIKDGDAGSVMASYNAVNNIYVVQNKKVLTEILKEGIGFQGFVMSDWWAIHDLEGSFNAGMDMNMPGGKAWGPDYVNNSFWGSNISNAIRSGQVSSSRLDDAVRRIIRTLYRFDQMSGYPNVNLKAPSMHADTNRQAAIESSVLLKNADDILPLTKKYRKIAIIGKDADKAQSCTDTACSGGNIIQGWGSGTTDFTGISDPITAIKNRASKEGISIVSSISDSANEGANVAKDADVAVVFVRATSGEEYIVVDNNKGDRNNLDLWHGGNDLVKSVAAVNKNTVVVIHAPATVNLPFLNNVKAIIHAGMPGAESGNAIASILFGDSNPSGHLPFTWAAREDYCCDVSYPAELPHGGNSKTAYDYKEGLFVGYRWFDKKNKTPIFPFGHGLSYTTFDYSNLSVSLKKSGTQVTGLEATVTVANTGSYEGATVPMLFLGFPAVSELGDYPVRNLKAFEKVNLKAGEKKTVTLTVDQHGLSYYNTSKKSFVVPTGGEFTVYVGKSAGDLPLKKAIKNTQGTNESSSSVGDENNNNPNNNADCSVNGYKCCSNSNAEVVYTDGDGNWGVENGQWCIIKEQQQQQTCFSIKLGYPCCKGNEVAYTDNDGQWGFENGQWCGIATATSGAGGCPYTSKNGYPVCQTTTKVEYVDSDKWGVENGNWCIMCN

SEQ ID NO: 9602 - protein, 491 aa, Bifidobacterium longum NCC2705
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 9603 - protein, 193 aa, Candidatus Blochmannia floridanus
MVNVILLNNLDSFTYNLVDQLRSNNHQVSVYSSQLPISVIMEALININNPILILSPGPGIPKHSGCMMYLIKQLKGRIPIIGICLGYQAIIQLYGGHISQSTEIFHGRSSLIYHDQLGMFTDIPNPLLVARYHSLIGIDIPNNLKINAYYNTKTAMSVRNDHDRICGFQFHPESILTAHGTQLINQTIKWTQI

SEQ ID NO: 9604 - protein, 178 aa, Glycine max
  unsure (1)..(178): unsure at all Xaa locations
MAYSMISSPSVTTVNRACAGMAAPYTGLKFMAGFPTRMTNNDITCIASLCGILQCMQVWSPICKTNSETLSYLPDLDDSHSPEELXYLLRKGWIPCLQFELEHGFVYREHNRSPGYYDGRYWTMWKLPMFGCTDASQVLKELQEAKTAYPNGFIRIIGFDNVRQVQCISFIAYQLPGF

SEQ ID NO: 9605 - protein, 618 aa, Zea mays
MISPAMCRSAPRRAAQVRRLLSSAAPPAHAGAAVPGPCIVHKRGNDILHDPWYNKDTAFPMTERDRLGLRGLLPPRVMSFEQQYERFINSFRSLEHNTRGEPDSIVALAKWRILNRLHDRNETLYYRLLIDNIKDFAPIIYTPTVGLVCENYSGLFRRPRGMYFSAKDKGEMMSMIHNWPAEKVDMIVVTDGSRILGLGDLGVQGIGIPIGKLDVYVAAAGINPQKVLPIMLDVGTNNEKLLEDKLYLGLRQPRLEGEEYLAVVDEFMEAVHARWPKAVVQFEDFQMKWAFETLQRYRNRFCMFNDDVQGTAGVALAGLLGAVRAQGRPLQDFTNQKIVVVGAGSAGIGVLSMAKQAMLRMPGIHRTGEGHNQFWVLDKDGLITKARKDLDSAVARFARGFGPDEVPDLYEGASLVEVVKKVKPHVLLGLSGVGGIFNEEVLKAMKESDSPRPAVFAMSNPTTKAECTPDDVFKHVGDKAIFASGSPFSNVSLGNGKSGYANQANNMYLFPGIGLGALLSGARHVSDGMLQAAAECLASYITDDEIRKGILFPSVSSIRHITARVGAAVVRAAVAEDLAEGCCDVGPRELGSMSESEAVDYVARKMWYPIYSPLVSDK

SEQ ID NO: 9606 - protein, 219 aa, ASPERGILLUS NIDULANS FGSC A4
MSSTSPSKEPEVEQEPQSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGGPVGGAASGPSVVRAGGAAAGGAFPEASDNAGSIMNQGLDPSEQDASAYGYPPMVGQGHNGAGGESY

SEQ ID NO: 9607 - protein, 559 aa, Oryza sativa
MRRLLLLPLLVLAGAAVGGGVVPVAARSAFACAAGGPAATLPFCRRSLPARARARDLVARLTRAEKVRLLVNNAAGVPRLGVAGYEWWSEALHGVSDTGPGVRFGGAFPGATAFPQVIGTAASFNATLWELIGQAVSDEGRAMYNGGQAGLTFWSPNVNIFRDPRWGRGQETPGEDPAVAARYAAAYVRGLQQQQPSSGRLKLAACCKHFTAYDLDNWSGTDRFHFNAVVTRQDLEDTFNVPFRSCVVDGRAASVMCSYNQVNGVPTCADAAFLRGTIRRRWGLAGYIVSDCDSVDVFYSDQHYTRTREDAVAATLRAGLDLDCGPFLAQYTEGAVAQGKVGDGDIDAAVTNTVTVQMRLGMFDGDPAAQPFGHLGPQHVCTAAHQELAVEAARQGIVLLKNDGRALPLSPATARRAVAVVGPHAEATVAMIGNYAGKPCRYTTPLQGVARYAARAAHQPGCTDVACAGSGQPIAAAVDAARRADATIVVAGLDQKIEAEGLDRASLLLPGRQAELISSVAKASKGPNDPKIAGILWAGYPGQAGGQAIADVIFGHHNP

SEQ ID NO: 9608 - protein, 163 aa, Triticum aestivum
AGRAGCSSALTDYYKRGQYIPGLKVNGMGVLAVKAAVKYGKEYTAADKGPLVLEYVTYRYGGHSMSDPGTTYRTREEIQRMRSTNDPIAGLKQKILDWEITTEEELKKIDKEARAHVNEEVAAAEAMAAPEAKPEILFEDIYVRGSEPEYIRGRIPEENHYFQ

SEQ ID NO: 9609 - protein, 342 aa, Synechococcus sp. PCC 7942
MVQERTLPSFQASQAQVSREEGLRIYEDMVLGRTFEDKCAEMYYRGKMFGFVHLYNGQEAVASGIIKAMRSDDYVCSTYRDHVHALSAGVPARQVMAELFGKETGCSRGRGGSMHLFSAEHNLLGGFAFVAEGIPVATGAAFTTAYRRNALGDTSADQVTACFFGDGAANNGQFFECLNMATLWKLPILFVVENNKWAIGMSHERATSDPEIYKKGPAFGMPGVEVDGMDVLAVRAVAQEAIARARAGEGPTLIEALTYRFRGHSLADPDELRSKEEKEFWLARDPIKRFAAHLTEFNLATHEELKAIDKKIEALVAEAVEFAISSPEPKPEELTRYIWAED

SEQ ID NO: 9610 - protein, 591 aa, Populus balsamifera subsp. trichocarpa
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLLGGSLADHTFLFLGAGEAGTGIAELIALEMSRRSKTPLEETRKKIWLTDSKGLIVSSRKESLQHFKKPWAHEHEPVKGLLEVVKAIKPIVLIGTSGVGKTFTKEVIEAMASFNEKPLILALSNPTSQSECTAQEAYTWTKGKAIFASGSPFDPVEYEGKVFVPGQSNNAYIFPGLGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 9611 - protein, 509 aa, Ammi majus
MALFLYLIIPCTIILLHQLYHKLRFKLPPGPRPWPIVGNLYDIEPVRFRCFNNWSKTYGPIISVWFGSTLNVIVNNTELAKEVLKDKDQQLADRHRSRSAAKFSRDGQDLIWADYGPHYVKVRKVCTLELFTPKRLEAIRPVREDEVTAMVESIYKDCTNSDTIGKSLLVRQYLGGVAFNNITRLAFGKRFVNSEGVMDEQGKEFKSIIANGLKLGASLATAEHIQWLRWLFPLEEEAFAKHGARRDNLTRAIMEEHTLARQKSGGTKQHFVDALLTLQSKYDLSEDTIIGLLWDMITAGADTTAIVVEWGMAELIKNPRVQEKAQEELDRVIGYERVLTELDFSNLPYLQCVAKEALRLHPPTPLMLPHRANANVKIGGYDIPKGSNVHVNVWAVARDPAVWKNPLEFRPERFLEEDVDMKGHDYRLLPFGAGRRVCPGAQLGINLVTSMLGHLLHHYSWAPPSGLSSDEIDMSESPGMVTYMKTPLQAVPTPRLPSQLYKRLAVEDM

SEQ ID NO: 9612 - protein, 455 aa, Gelidium crinale
  unsure (1)..(455): unsure at all Xaa locations
AVKETDVLALFRITPQPGVDPVEASAAVAGESSTATWTVVWTDLLTACDLYRAKAYKVEAVLNTADQYFAYISYDIDLFEEGSIANLPASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATXEDMYERAEXAKQLGTXIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 9613 - protein, 396 aa, Oryza sativa (japonica cultivar-group)
MATFSGTDRLRDLHAFDDTKAGVKGLVDAGVTTVPYFFRHHPDPLPVAAPSEAAAAIPLIDLAKADVDRGHVVSQVRSAAESAGLFQVVNHGVAGELMDAMLAAARRFNEQPAEAKAPYYTRDLGSKVRFFCNFDLFQSPAAQWRDTLYVEMVPDAPSPEEIPPPLRGVAEEFAAAVWRLGERVTELLSEALGLPPGYLAEHAGCMDGMSMVAQYYPPCPEPEKTMGTTRHSDPSFLTVLLQDESGGLQAVLPRPPEERWVDVPPVAGALVVNVGDLLQLVSNGRLRSMEHRVLPTAASAARARVAVACFFRLEYSASLTRPRSYGPIVDSGEGGARRAAAVYRSTTPRDFLAYFNGKGLDGRSALEHFRIPEAAAASSAVDVVSSSTTAAASIPR

SEQ ID NO: 9614 - protein, 405 aa, Glycine max
RVSYVGPPPRLYFFLSPFFHLLLFSRHYPKLADFHIPSNMKGRFMFLSVLLCATFHVSFSITDGLVANGNFELGPKPSALKGTVVIGGSHSIPEWEISGFVEYIKSGQKQGDMLLVVPEGAYAVRLGNEASIKQRIKVIKGMYYSITFMVARTCAQEERLNISVTPDWGVIPIQTLYTSSGWDPIAFGFKAENETVEMLIHNPGKEEDPACGPLVDSVALRTLYPPRATNQNILKNGGFEEGPYVFPNSSWGVIIPRNIEDDHSPLPGWMVESLKAVKYIDSGHFSVPQGKRAVELIAGKESAIAQVARTIPGKTYVLSFSVGDASNSCEGSMIVEAFAGKDTIKVPYESKGKGGFKRAALKFVAVTPRTRIMFLSTFYTMRSDDFSSLCGPVIDDVKLVSLRKP

SEQ ID NO: 9615 - protein, 507 aa, Xanthomonas campestris pv. campestris str. ATCC 33913
MRPGSLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPESTRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPDDLAKFDFDPLDATKIWPDVPEQKVGQMVLNKNVDNFFQETEQVAMAPANLVPGIEPSEDRLLQGRIFSYADTQLYRIGTNGLSLPVNRPRVAVNNGNQDGEANTGHTTSGVNYEPSRLEPRPQDTAARYSELPLSGTTQQAKITLEQNFKQAGELYRSYSKKDRADLVQSFGESLATTDTESKHLVLSFLYKADPEYGAGVTRVAKGDLARVKQLASTLQD

SEQ ID NO: 9616 - protein, 197 aa, Yersinia rohdei
SSIGGWKGINESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 9617 - protein, 165 aa, Glycine max
MEPYKRGTCSAFNSAFWTTNSGAAIWNNNFLLTVGASGPILLEDYHRAEKIASFDRERIPERVVHAMGASAEGFFEVTHDIFDLTCADSLRAPGVQTPDFDRLSTGIHERGSPETLKDPRGLAVKLHTREGFFDLAGNNLTMFFVRDGMKFADMGDALRPQPQNH

SEQ ID NO: 9618 - protein, 196 aa, Ralstonia metallidurans
MIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 9619 - protein, 301 aa, Bifidobacterium longum NCC2705
MKGIILAGGSGTRLYPLTTVTSKQLLPVYDKPMIYYPLSVLMMAGIRDILIISTPKDLPNFERLLGDGSHYGVRFSYKVQPSPDGLAQAFLLGEEFIAGEPCTLVLGDNIFYGNGLGATLRGAVAKAESGEGASVFGYYVDDPERYGVVEFDEDRKAVSIEEKPSKPKSHYAVTGLYFYDEHVVEYAKQVKPSPRGELEITDLNRMYLDAGRLNVRTLGRGYAWLDTGTMDSLFEAGEFVRTVQRAQGLPIAIVEEIAYENGWITRDQLMESAERYGKSPYGRHLKGIADGEIMLVPNQKN

SEQ ID NO: 9620 - protein, 338 aa, Xylella fastidiosa 9a5c
MSVALSIDLSKKKTILCFGEALIDMLAQPPVKKGMPRAFLQCAGGAPANVAVAVARLGGAVQFVGMLGRDMFGDFLFDSFAEAGVVTDGIVRTSAAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTARGQVPTFRVQVQDSNAAGDAFVGGMLYTFAQQFDDAAALIDFCHDPESIASMLRFAAAVGALAVTRHGAFTAMPMLSEVLSLIQEQS

SEQ ID NO: 9621 - protein, 204 aa, Zea mays; identical to SEQ ID NO: 6514

SEQ ID NO: 9622 - protein, 1294 aa, Arabidopsis thaliana
MVFKSKLFFSSKKSRSSSPSSSNSPRSVGSDSPIRSDKKKPKSNSKEETRSPNTKKHVSAKGKEASLEVHSSSPGKSNSSSSGSEAKKPITETPATSDVKEESPASVSPIMASSLGLNRIKTRSGPLPQESFFSFENDYAIPVLPCYKLSKLDTGKKEAGSSKVDIGPLRSSNPALLASGTGQFKVSPTISGPEGSAEVCTPENSYDLDDPKESDSPRYQALLRMTSAPRKRFPGDIKSFSHELNSKGVRPFPLWKPRRLNNLEVVFEATFSDILNLIRTKFDKAKEEVNSDLFAFGGDLLDIYDKNKESHPELLVTIEDLLVLAKTCAKTTSKEFWLQCEGIVQDLDDRRQELPPGVLKQLHTRMLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKTILLSVEASIAQAENLLEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVSCSSFKHIKSSAEISYTNVRFFYSFTCSENLYLVMEYLNGGDFYSMLRKIGCLDEANARVYIAEVCRYYSCQVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEYSDETNIMTQVKQHSFFKDIDWNTLAQQKAAFVPDSENAFDTSYFQSRYSWNYSGERCFPTNENEDSSEGDSLCGSSGRLSNHHDEGVDIPCGPAEFETSVSENYPFDNFSFKVFYHDFLPKIPCHPSIRYIIVLYSCRSSLACSFRIENLLQTLSV

SEQ ID NO: 9623 - protein, 308 aa, Glycine max
  unsure (1)..(308): unsure at all Xaa locations
RVSWGHKKSFIFVDRGFYSIETSLLLLALKDPTEHTAIDNLMVQQLDGTVNEXGWCKQKLSKGTLLGMRQTIFEFIFDSLNQRYPSFSFLSLYMPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVXQIGSVTESIE

SEQ ID NO: 9624 - protein, 305 aa, Clostridium perfringens str. 13
MKNFLESLIENNRQYVEHGKLASYIPELEKANKEDLGIYIVTLDGKEVGAGEYDKKFTIQSISKVITLMLAILDNGKDRVFSRVGVEPTGDSFNSIVSLERKPSKKPFNPMVNSGAILTTSLIEGDSEEEKFERILEFTRKVTGNDDIQLNEDVYLSEKETGDRNRALAYFMKSNGVIEGNIDDILDLYFKQCSLEVNAKDLARFGAMLANDGVLPWNGERVISREICRIIKTIMVTCGMYDDSGKFAVHIGIPAKSGVGGGIMAAVPRRMGIGIFGPSLDDKGNSIAGTHVMKDLSEELDLSIF

SEQ ID NO: 9625 - protein, 512 aa, Schizosaccharomyces pombe
MNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 9626 - protein, 258 aa, Burkholderia fungorum
MDKAMESLAGLENVDVVELNLADPDSVDNFATSYLRTHNSCDILVNNAGIMATPLTRDSRGYELQFATNHLGHFQLTVQLWDALAVAGSARVVALSSLGHRFSAINFDDLNYLTRPYDPWRAYGQSKTANALFAVHLDRLGKGAGIRGFAVHPGRIPTTNLSRHMTDEEKKAATQAVQVGPDYVPSPLKSIAQGASTSLWAATSAQLSGKGGVYCADCDISPIVADDSPDVRGVRRWAIDPDQAVRLWDVSLDLVARR

SEQ ID NO: 9627 - protein, 395 aa, Glycine max
  unsure (1)..(395): unsure at all Xaa locations
GLFKQRITKDGQEEVADDWLEMGNPWEIIXNDVSYPVKFYGKVVSGSDGKKPWIGGEDIKAVAHDVPIPGYKTKTTINLRLWSTKAASEEFDLSAFNAGRHTEASEALANAEKICYILYPGDESIEGKILRLKQQYTLCSASLQDIIARFERRSGANVNWEEFPEKVAVQMNDTHPTLCIPELMRILIDVKGLSWKDAWNITQRTVAYTNHTVLPEALEKWSLDLMQKLLPRHIEIIEMIDEELIRTIIAEYGTENSDLLEKKLKEMRILENVELPAEFADIVVKSKEAIDIPSEELQSSEQAEVEEXELPEPVPEPPKLVRMANLCVVGGHAVNGVAEIHSEIVKDEVFNAFYKLWPEKFQNKTNGVTPRRWIRFCNPDLSXIITEWIGTEDWV

SEQ ID NO: 9628 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMAAVKHMPFGWQKSFMAAVNNYKPVFTFGAWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 9629 - protein, 114 aa, Actinobacillus pleuropneumoniae serovar 1 str. 4074
MARQPFLIAPSILSADLARLGEDVAEVLKAGGDIIHFDVMDNHFVPNLTFGPAICKALRDYGITAEIDVHLMVKPVERLIPDFAKAGANYITFHPEATDHIDRTLQMYRVSGCK

SEQ ID NO: 9630 - protein, 319 aa, Yersinia pestis CO92
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 9631 - protein, 258 aa, Glycine max; identical to SEQ ID NO: 5203

SEQ ID NO: 9632 - protein, 980 aa, Thermosynechococcus elongatus BP-1
MTGLYEAETIAIARQLWAASQESRNFFSQLREQMRIEDKLLGWAMEHPGLRVQLFRLIDCLPSLRSQTEVARHLQEYLSDPSVELPPGLKKLLNFAQPDSLPAQAAATTFTTAVQALAHKYIAGETTEQVLKTIGRLRKQGMLVTMDILGEAVITEAEAQQYCDRYLDLMEHLSPLGQREGVNPVQVSVKLTAFYSQFDPLDVSGCRAKVGEPIRRLLHRAQELGVAVHFDMEQYAYKDITLAILKDILLEPEFRDRADIGLTLQAYLRDSYQDAQDLITWVQQRGTPITVRVVKGAYWDQELIKAVQHHWPLPVYQHKQNTDANFERIIELLLSHHTVLRTAIASHNVRSQARAIAIAQRQHIPPTAMECQVLYGMADKLAKALVEAGQTVRVYCPYGDLIPGMAYLIRRLLENTANSSFLRQQLGAVAIEELLAPPEPTADFEAVNVHLTTGKTSTFVNAANSDYARASQREAIQAALIHVHRQLGQTYTPIINGDRVNPREYSESLNPSQPEEIVGRVGLATIEDAEHAIRAAKAAQAQWQQTSVAERATLLRRAADLLEAQRHELVAWMCYEVGKVVAEGDAEVSEAVDFCRYYADEMERLSSGYDRNFPGETNHYHYQGRGLAVVISPWNFPLAIPTGMTAAALVTGNCTILKPADPAAVVAAKLAEILMAAGFPPGVFQFLPGRGSVIGPYLTQHPDVHLIAFTGSQEVGCRIIAEAAVLQRGQSHIKRVIAEMGGKNAIIIDESADLDQAVAGVVQSAFGYSGQKCSACSRVIVLESIYKPFVERLVAATQSLNIGPAHLPSTRVGPVVTAAARDRIQEYIAKGQQEAELLLSVPVPEMGYFVSPTIFTNVPPTATIAQEEIFGPVLAVLRAETFTQALAIANATAYALTGGLYSRTPSHIQQAKAQFAVGNLYINRGITGAIVDRQPFGGFKLSGIGSKAGGRDYLLQFLEPRVITENVQRQGFAPIAGVDD

SEQ ID NO: 9633 - protein, 370 aa, Streptococcus pneumoniae R6
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 9634 - protein, 91 aa, Zea mays
SNLYSLNAGSRTMSDKREFPTVPLVKLGSSFTKVQDYLRRFESIPDMLELDHLTVSGDVTFGKNVSLQGTVIIIAYHGDTFDIPPGAVLEH

SEQ ID NO: 9635 - protein, 458 aa, Rhodococcus rhodochrous
LQIVHQATADDVDEAVAAGRVAAADPAWRRMLPHERARYLHRIADAIEHEASRLALLQSYNTGKTLTETTALVGSAAGTFRYFAAVLETSDDDLTTQRGNYLTMSIHEPIGVIGAIAPWNSPIASDAQKIAPALAAGNAVVLKPAEWTPLVSMALARAIHDSGLPPGLLSVLPGKGSIVGDAIVQHPHVGKVTFTGGTRTGRAVAHAGAEKLMPVSLELGGKSPTIVLDDADIEAAVAGVMYGIFSSTGQSCIAGSRLFVDRSLYEAFMERLVERTRALRIGNGRDPRTQVGPLVHHTHRASVARYVDLARCEGGRVLCGGTAPDDPELADGAYYLPTVIDGLSNDAAVCQDEIFGPVLIALPFDGESDLLAQANDSVFGLASGIWTRDYRRAWRLARQLEAGTVWVNTYKRFSISTPFGGIKESGLGTEKGRAGIAAYSRQKSIYLGLDDEPDRWVD

SEQ ID NO: 9636 - protein, 348 aa, Glycine max
  unsure (1)..(348): unsure at all Xaa locations
MAGGQLGVLNALDVAKTQWYHFTAIVIAGMGFFTDAYDLFCISLVTKLLGRLYYTDISNPKPGALPPNVQAAVTGVALCGTLAGXLFFGWLGDKMGRKRVYGLTLMLMXNLVGTTVTWFLLDIAFYSQNLFQKDIFTAIGWIPPAQDMNAIHEVYRIARAQTLIALCTVPGYWFTVXFIDIIGRFAIQLMGFFFMTVFMFALAIPYNHWKNHNNIXFVVMYSFTFFFSNFGPNATTFVVPAEIFPARLRSTCHGISAAAGKAGAIVGAFGFLYAAQSTNPNKVDHGYPTGIGVKNSLIVLGVINFFGMVFTLLVPESKGKSLEELSGENEDDGAEAIEMAGSARTVPV

SEQ ID NO: 9637 - protein, 417 aa, Thermococcus profundus
MKKLEKKLSAEPINFDSFFSEKAMLMKASEVRELLKLVETSDVISLAGGLPAPETFPVETIKKIAVEVLEEHADKALQYGTTKGFTPLRLALARWMEKRYDIPMSKVEIMTVAGSQQALDLIGRVFLNPGDPIVVEAPTYLAAIQAFKYYDPEFISIPLDDKGMRVDLLEEKLEELRKQGKRVKIVYTVSTFQNPAGVTMSVDRRKKLLELANEYDFLIVEDGPYSELRYSGEPTPPIKHFDDYGRVIYLGTFSKILAPGFRIGWVAAHPHLIRKMEIAKQSIDLCTNTFGQAIAWKYVENGYLDEHIPKIIEFYKPRRDAMLEALEEYMPEGVEWTKPEGGMFVWVTLPEGIDTKLMMERAVAKGVAYVPGEAFFVHRDKKNTMRLNFTYVPEETIREGVRRLAETIKEEMKRVKG

SEQ ID NO: 9638 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRSSSRKLRSDQVAAPAHRSQPTTGLTMVLHASSIELSHYFQFLLKFVLLAYAVLCLTELLHRWSNGSVLSLWSA

SEQ ID NO: 9639 - protein, 319 aa, Zea mays
  unsure (1)..(319): unsure at all Xaa locations
RQLPLSPRGCSRRRPLCPRVLLPTFAPLHVHGDTMPAPKWFQKLRGRRSXASSKARAAEASPPPPPPPXYAPAQGQRPSSLPAPCAVSPNRASYYFASADRARQDRDLPCAADAAAAXLDVRVDVVHXRAGDXRLGGXXAPPGTPELQXRPIVTRPPVDXASASGGVSSASATTSAATTPSTRARRFHVSSPMARRRRRRRCDHDSVAIKKGKAAAAEEGEGEVSPAPSLRPPTRRXXRRRRRWLYESLVVVKTSSDPERELAESMSEMVVANGIXSSEDLEELLACYLALNAAEHHRAVVAAFRRVWLLLDKHRLLLI

SEQ ID NO: 9640 - protein, 287 aa, Rhodospirillum rubrum
MRHHHPMTLPGEPEATLLLMPAWALDGPPESRIIMVKVATVHPGNGARGLPAVAASVLAIDGGTGRPLALLDGGELTARRTAATSALAARFLARRDARVLVAVGAGRMIANLIEAHLCASPSIETIRIWARDPAKAADLCEDLADRLPFAPQVAPDLQTAVRGADIITCATLSREPLVHGAWLAEGSHLDLVGAFTPEMRESDDEAMRRATVFVDTRAGACHEGGDIVQAMSSGALTTQDIGGDLFDLVRGDHPGRTSASEITLFKSVGAAIEDLAATDLAFSLYKD

SEQ ID NO: 9641 - protein, 272 aa, Arabidopsis thaliana
MSKSTSVSTILYLRQRLQGLKIYETSDLIQHINTFDELVGEQVSVDVKIEEKTKDMILLCSLSPLLTTLTCSMVKVAASLRFPNERWLEVITKEPRAFVYHNFLALFFKICKTNEECDHLISLAKPSMARSKVRNALTGLGEESSSRTSSGTFIRSGHDKIVKEIEKRISEFTFIPQENGETLQVINYEVGQKFEPHFDGFQRIATVLMYLSDVDKGGETVFPEAKGIKSKKGVSVRPKKGDALLFWSMRPDGSRDPSSKHGKRHCLSLNLF

SEQ ID NO: 9642 - protein, 159 aa, Glycine max
MDFRVMGLESPLFHTLQHMMDMSEDGAGDNKTHNAPTWSYVRDAKAMAATPADVKEYPNSYVFEIDMPGLKSGDIKVQVEDDNVLLICGERKRDEEKEGVKYLRMERRVGKFMRKFVLPENANTDAISAVCQDGVLSVTVQKLPPPEPKKPRTIEVKVF

SEQ ID NO: 9643 - protein, 407 aa, Triticum aestivum
  unsure (1)..(407): unsure at all Xaa locations
MATDAGAADRSSVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQXLLLKEVSKSSTEDGNNSGPPSPVAASQTSSQAAAFPDFKLVEVPKEVVNEKNEPESETIRSPKAPTHSFKKPIGGKKPGSKTGGLGARKLTTKPSESLYEQKPEEPAPALPSVAESTTARSKSHTSRFEYVENVPSAGSSSAENQAFGHVAPPKSSNFFXGEYGMDSGYHKKSTSGASKMQVEESSEARQKFSNAKSISSSQFFGDQANLEKEGQISLQKFSGSSAISSADLFGQQANNSNADLSASDLINRISFQATQDLTSLKSMAGQTGKKLTSMASNIISDLDRIL

SEQ ID NO: 9644 - protein, 117 aa, Triticum aestivum
VEPALDILDALASVPEGMTALKDCPRTIPNAVRLLMRVSEACTQRALSMLWVVCRMVPDESAPAALEVGLAAKLLLVIQSGCGPELKQQASELLKLCTVHCTSTVFLAKCKLTKTIQ

SEQ ID NO: 9645 - protein, 579 aa, Corynebacterium glutamicum ATCC 13032
MAHSYAEQLIDTLEAQGVKRIYGLVGDSLNPIVDAVRQSDIEWVHVRNEEAAAFAAGAESLITGELAVCAASCGPGNTHLIQGLYDSHRNGAKVLAIASHIPSAQIGSTFFQETHPEILFKECSGYCEMVNGGEQGERILHHAIQSTMAGKGVSVVVIPGDIAKEDAGDGTYSNSTISSGTPVVFPDPTEAAALVEAINNAKSVTLFCGAGVKNARAQVLELAEKIKSPIGHALGGKQYIQHENPFEVGMSGLLGYGACVDASNEADLLILLGTDFPYSDFLPKDNVAQVDINGAHIGRRTTVKYPVTGDVAATIENILPHVKEKTDRSFLDRMLKAHERKLSSVVETYTHNVEKHVPIHPEYVASILNELADKDAVFTVDTGMCNVWHARYIENPEGTRDFVGSFRHGTMANALPHAIGAQSVDRNRQVIAMCGDGGLGMLLGELLTVKLHQLPLKAVVFNNSSLGMVKLEMLVEGQPEFGTDHEEVNFAEIAAAAGIKSVRITDPKKVREQLAEALAYPGPVLIDIVTDPNALSIPPTITWEQVMGFSKAATRTVFGGGVGAMIDLARSNIRNIPTP

SEQ ID NO: 9646 - protein, 281 aa, Glycine max
  unsure (1)..(281): unsure at all Xaa locations
MGQGTPGGLNRQGLPGDRKPDGGDKKEKKFEPAAPPARVGRKQRKQKGPEAAARLPTVTPLSKCKLRLRLKPQEEKAEEDRSKVDDLRGSPMSVGNLEELIDESHAIVRSSVGPEYYVGILSFVDKDQLEPGCAIVMHNKVLSVVGLLQDEVDPMVSVMKVEKAPLESYADIGGXLDAQIQEIKEAVELPLTHPELYEDIGIKPPKGVILYGEPGTGKXTLLAKAVANSTSAPFLRVVGSELIQKYLGDGPKLVRELFRVADDLSPSIVFIDEIDAVGTKR

SEQ ID NO: 9647 - protein, 114 aa, Oryza sativa (japonica cultivar-group); identical to SEQ ID NO: 8538

SEQ ID NO: 9648 - protein, 246 aa, Lolium perenne
MGRGRVELKRIENKINRQVTFAKRRNGLLKKAYELSVLCDAEVALIVFSNRGKLYEFCSTQSMTKTLEKYQKCSYAGPETTVQNRENEQLKNSRNEYLKLKARVDNLQRTQRNLLGEDLDSLGIKELESLEKQLDSSLKHIRTTRTQIMVDQLTELQRREQMFSEANKCLRIKLEESNQVHGQQLWEHNNNLLSYERQPEVQPPMNGGNGFFHPLDPAGEPTLHIGYPQESLNGSCMTTFMSPWLP

SEQ ID NO: 9649 - protein, 155 aa, Zea mays
  unsure (1)..(155): unsure at all Xaa locations
MGRKFFVGGNWKCNGTTDQVEKIVKTLNEGQVPPSDVVEVVVSPPYVFLPVGKSQLRQEFHGAAQNCWVKKGGAFTGEVSAEMLVNLGVPWVILGHSERRALAGXESNEFGGDKGAYALSQGLKCIAWXGETLEPEGRRGLSMGGWVLHKQKAIG

SEQ ID NO: 9650 - protein, 510 aa, Zea mays
MAAGPKKTHIVPYTLLPPSASEVPSVTQHLTSLAILRRLRLCFPRAVAMAAAPAGAPAITASSSFVSSSPFCLKASMTSQRRPAGRVSIVIRCVSSPPAVDTSFKTNVPRNANMAKLQAGYLFPEIARRRAAHLLKFPDAKIISLGIGDTTEPIPNVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCGPENGFFPDLSTVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNIAQAGGLACLSPDGLKAMQDVVGFYKENTEIIVETFTSLGFNVYGAKNAPYVWVHFPGRNSWDVFAEILEKANVVTTPGTGFGPGGEGFVRVSAFGHRENIIEAARRLKQLYK

SEQ ID NO: 9651 - protein, 214 aa, Oryza sativa; identical to SEQ ID NO: 9521

SEQ ID NO: 9652 - protein, 1296 aa, Arabidopsis thaliana
MVFKNKLFFSSKKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRKKEAGSSKLGLEENMDRTRPSDNKSDRDSLSPDTGPPRSLSPTLPPSGSRLQNVASSSGTGRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 9653 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDFTLIMQLLRDNLTLWTSDAEYSAAAAGGNTEGAQENAPSNAPEGEAEPKADA

SEQ ID NO: 9654 - protein, 288 aa, Staphylococcus aureus subsp. aureus Mu50
MKKIKKAIIPAAGLGTRFLPATKAMPKEMLPILDKPTIQYIVEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKALGL

SEQ ID NO: 9655 - protein, 486 aa, Bradyrhizobium japonicum
MNAHTGTVRGKERYRSGVMEYKRMGYWEPDYTPKDTDVIALFRVTPQEGVDPIEASAAVAGESSTATWTVVWTDRLTAAEKYRAKCHRVDPVPGTPGSYFAYIAYDLDLFEPGSIANLSASIIGNVFGFKPLKALRLEDMRFPVAYVKTFQGPATGIVVERERLDKFGRPLLGATVKPKLGLSGRNYGRVVYEALKGGLDFTKDDENINSQPFMHWRDRFLYCIEAVNRAQAASGEVKGTYLNITAGTMEDMYERAEFAKELGSCIVMIDLVIGYTAIQSMAKWARRNDMILHLHRAGHSTYTRQKSHGVSFRVIAKWMRLAGVDHIHAGTVVGKLEGDPNTTRGYYDVCREDFNPTKLEHGLFFDQSWASLNKMMPVASGGIHAGQMHQLLDLLGEDVVLQFGGGTIGHPMGIAAGAIANRVALEAMILARNEGRDYVHEGPEILAKAAQTCTPLKSALEVWKDVTFNYQSTDTPDFVPTALETV

SEQ ID NO: 9656 - protein, 143 aa, Oryza sativa
MISSKKLVQLSKKWQGMGAIGRKRVTASEKEIIHHSSCSSSVAGKGNCVVYSCDGRRFEIPLAYLRTPVFVELLRMSQEEFGFSSDGRITLPCDAAVMEYVMCLLGREASEEVEKALLSSIVMPCSHHPSRMAQHQHFAVCSI

SEQ ID NO: 9657 - protein, 489 aa, Oryza sativa
  unsure (1)..(489): unsure at all Xaa locations
MARTISAPEVIQCDLPPSFPASIPEESPTRPSNSTATDSAEEPTAAALGQESPKAAPAVAAVAPLAGLPLLSPKRGGGEVGIRGARPPVLSPPQPLMALAPPPMRRSIVAKDMSGVSAWDIVNSFAPSEEKSEVRTDDERVDASHMSDTEEEEEFADEGVAGVDGELKELRIGETFEGFTGTSSLSTTNDDDASSTTTEAMFIISPNGKFKRKIKSWMRGALLGSGSFGMVYEGISDEGAFFAVKEVSLLDQGSNAQQSILALEQEIALLSQFEHENIVQYYGTDKEESKLYIFIELVTQGSLSSLYQKYKLRDSQVSGYTREILNGVXYLHERNVVHRDIKCANILVHANGSVKLADFGLAKEMSKINMLRSCKGSVYWMAPEVVNPKKTYGPQADIWSLGCTVLEMLTRNIPYPNVEWTNAFFMIGKGERPQIPSYLSKDAQDFISQCVQVDPEQRPSASQLMSHPFVNRPLRASFESASPPAISSY

SEQ ID NO: 9658 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 9659 - protein, 728 aa, Aspergillus fumigatus
MRLTFIPSLIGVANAVCPYMTGELNRRDEISDGDRAAATEEFLSQYYLNDNDAFMTSDVGGPIEDQNSLSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPERELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKEHGVDVVLVAEALADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 9660 - protein, 340 aa, GIBBERELLA ZEAE PH-1
MSSLPQTYKACVIEKANAPFTLKDVPLKHPSKGQILVKVLACGVCFSDVGVSEGHMGDVFPRVPGHEIIGDVVEVGEDVDNFKNGDRVGGPWHGGHDRTCRQCQRAQFQMCDHKEVNGVSRDGGFAEYVLLRSEAVVRVPKEIEPADAAPLLCAGVTVFNGIRKMHVEQGRIVAVQGLGGLGHLAVQYAYKMGYEVAVLSSTDDKADFAKKLGAHHYINTKTSDVGEELNKLGGASIIVQTAPNPKAISPLIQGLAPEGKLLNLAPVGGAEFDTVALVLKGASVVGWPSGHALDSEEALRFSLTHGVKCMVEKYPLEKVQDAVDSLKAGKPRFRNVLVME

SEQ ID NO: 9661 - protein, 181 aa, Zea mays
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 9662 - protein, 294 aa, Glycine max
  unsure (1)..(294): unsure at all Xaa locations
MDPPPSKFVIEASEALALAESAAVTLPELLPTLVPAAQPLARPPISKFSVAAVGLAPSGRIFVGVNLEFPGLPLHHSVHAEQFLITNLSLNAEPHLVSLAVSAAPCGHCRQFLQELRAAADVKILVTSEATAEFRALSDFLPHRFGPHDLLPLEAPLLLEPHHNTLTLQHYLNAHVPNHKLKIAALEAANKSHAPYSGSPSGVALLDCHGNVFKGSYMESAAFNPSLGPVQAALXVAFVAGGGGDYDRIVGAALVEMDGAVVKQEHTARLLIHSISPNCQFDTFLCHNNNNNEY

SEQ ID NO: 9663 - protein, 373 aa, Nitrosomonas europaea ATCC 19718
MMNLSELAPDYIRAIQPYQPGKPISELVRDLGLNKDEVVKLASNENPLGTSPLAKEAMIQALNESARYPDGSGFELKAALSERLGMPADQIVLGNGSNDVLELATRIFLHPDSTAIYSQYAFAIYPLLAQAVGARGIAVPARNYGHDLEAMLAAVTPETRIIFIANPNNPTGTLCDARDLLRFMERVPQDVLVILDEAYDEYLPEANKANSIAWLKNFQNLVITRTFSKAYGLASVRVGFALAHADIANLMNRIRQPFNVNSIGLAAAQAALKDVEFVKLAYMTNRTGMQQMTHGLDQLGIEYIPSFGNFVCCHIDGHPANTLKIYRNLLQQGVIVRPLGNYDMLNHLRVTIGIEEENKRFLQALEQALKELD

SEQ ID NO: 9664 - protein, 497 aa, Bradyrhizobium japonicum USDA 110
MTPTAAARAQHATATLRDRLKDPSLLKEACYIDGAWVGTPVFAVNNPATGVELAKVPQLGADDTTKAVEAAERAFPAWAKHTAKQRSNILRKWFELIIANREDLALILTSEQGKPLSEALGEVDIGAAYIEFFAEEARRVYGETIPTQRPDARLLAIKQPIGVCGAITPWNFPNSMITRKVSPALAAGCTVVLKPANETPLSALALAVLAEKAGIPKGVLNIITGDAPPIGKVLCEHPAVRFVGFTGSTAVGKILYQQASVGVKRLGLELGGNAPFVVFDDADIDAAVEGAIVSKYRNMGQTCVCANRLYAQDKIYDEFVQKLSKKVAVMKIGDGTEAGVTQGPLINLKAVDKVERHIADAVKRGAKVVTGGKRSELGRSFFEPTVLADVKPDSLVAQEETFGPLAPVIRFKDEADVIAMCNASPFGLASYFYSRDLGRVWRVAEALESGMVGVNTGLITTEVAPFGGVKESGLGREGSRHGMEEYVEIKYVMMAGV

SEQ ID NO: 9665 - protein, 706 aa, Neurospora crassa
MPPLTASPSIEGSASTPTDSQIDSATIIFWVSGAIWILVAGSYMTFLMAIMDERVDSTEETGVVVAPRTRFTARILWAVLKGLLWPLVLLWILVESAVMDCCIPVCKWCAGGCMYDGTPKTKYRSKKILKPTAKDRNPVTNARIRLNESQTRRCRLSLENRAGGPDCCKQLEKAQLERLLTDVILTISNYLSILPGRISSAVRNEHARYSIRSKPKMHTTPLTTMAMQYQAALQILQKTANDMSKRRTRTEELVPLEDSVGRTAAKDILSPDSTPPFDTAAADGFALVSSATINASPMNPVYFRVAGTITAGEKPPLMPPCRGPDGVLQCYEIMVGARFPDTATEHLIHMDACVWATDVQEVSVSEVPKADPQLGNRFIKITKPVTYNANRRRAGEDISKGDRLIRAGMKIRSSHVLPLASVGIKEVAVEPLVRVGVWSTGREIVRSDVDGPTATKRSSTRYTYDADGPYLMAALKEFGAEPHFLGLLPGDDPAVLEKALGETMATDKFDVLVTTGAATPGRSGFVRSVIEKLGGQVHFHGVAMRPGGTAMFASLESTAPNNGLVSFFGLPGDPCAMAASFRFLIVPYLQFVRGEKADEPLMATLELRCSTRQESEPNMDAGAPVEASMGNDCGPLCMDCFRHGRVTASEDGRRKVVRMTKDQGPGKVYPFIEANCWIHLPHGQEIVQGAMVPCLSLSACRDEKWQ

SEQ ID NO: 9666 - protein, 352 aa, Xanthomonas campestris pv. campestris str. ATCC 33913
MSKAHAYAAQTADQPLAPFVFERRAPGPDDVQIDIAYCGVCHSDLHTARNEWHNTVYPSVPGHEIVGRVTAVGSAVTNFKVGDLAGVGCMVDSCRSCASCQEGEEQYCEQGFTGTYNGPMFGGGENTYGGYSDHIVVDQKYVLHISHSDNLAAVAPLLCAGITTYSPLAHWKVGPGQKVGVVGLGGLGHMAVKIAKAMGATVVLFTTSESKRADALRLGASEVVISKDEAQMAAQYNTLDFILNTVAAPHNLDPFLNALKRDGAMVLVGVPEHSHPSPAVFNLVMKRRTLAGSLIGGIRQTQEMLDFCAKHNIVSDIETIRADQINEAYERMLKGDVKYRFVIDMDTLAKAA

SEQ ID NO: 9667 - protein, 263 aa, Zea mays
MDRHKCKLCSRSFSNGRALGGHMKAHLASLPLPLPPKLHSCFSSSDSEQEQSLRENPKKTLRILDPEDRESETESNKNPTRQRSKRNWKSTMPKLSLGHPEAEPLSSVSDTSPEEDLAMCLMMLSRDTWQEHKLANAGPPKTRCSSGSEIKLKNKVRSKHLCHACHKSFRSSRALGSHRTLCSPRLEAQNNSIISNNNIKVFECPFCYKLFGSGQALGGHKRSHLIPSSSSTVNHSVKLKQSFIDLNLPAPAEDDDLSVVSDA

SEQ ID NO: 9668 - protein, 179 aa, Helicobacter pylori 26695
MNETLKEELLQSIREVKDYPKKGILFKDITTLLNYPKLFNKLIDTLKKRYLALNIDFIVGIEARGFILGSALAYALGVGFVPVRKKGKLPAHTLSQSYSLEYGSDSIEIHSDAFRGIKGVRVVLIDDLLATGGTALASLELIKALQAECIEACFLIGLKELPGIQLLEERVKTFCLLEC

SEQ ID NO: 9669 - protein, 295 aa, Halobacterium sp. NRC-1
MSRVVAAGHVNWDVTLRVDALPEPDGEAEIVSQRRSGGGSAANVACALAGFDIDAGLVGSVGDDEHGLLAQRELQAAGVDLAGLRVVDGLETSVKYLLVDSRGEVMVLGNDGANEAVAPGDLDPAVVGADCEHVHLTSQRPATAARLTALAREHDATVSFDPGRRLRDRDYGDALARTDILFVNDNEAGAVLDDDGGPTAPDSDRVVVVKHGSEGATVHTPSGSVTHPGFAVDPVDTTGAGDAFAAGFVAVVLDGGDHERALEFGNACGALAAQHEGARTAPTRADAASFLDSQF

SEQ ID NO: 9670 - protein, 531 aa, Coxiella burnetii RSA 493
MKLKRIFSPLIILLISINGMIGSAWLFGPYFAAKTAGPAALVSWLVGGGLVLIVAFTFAELSTMFPVAGGIARIPQYSHGMATGFMMSWIAWLSCVAMPPIEVLATLQYTSFFFPRLTCLHGNQHVLTHEGLVGAALLMFFLSWLNIASVKHLVRSNVLMTVFKIGIILVIAITLIAVGFHGKNFFAYGGFAPSGWHGIVSAVSMGGIAFAFTGFRHGVELAAETKNPKQAIPLAIIGSIVFCLLLYWLLQLAFIGALHSPSLSKGWAQLAYQGDVGPFSGIAALLGLGWLSWMIYANAVISPLGGALVYVTSTSRIVYGMSKNAYFPAFFMRLNKKAIPVWCIALNGLTGFVLFFVLSGWQSMINFLVSAVVISYGTGPISLITLRYQMPNANRPFKLPQGILLSTLAFYVCNLMVFWCGWESIKKLFAAILIGILFFIVFQKTKQQRLREIHLKYSLWLIIYLGGLTLISYLGSMGGGMGIIPFGWDFIVIALFSLVSLYLAVKSRLPQISAQTHQANTLDSVDSEASA

SEQ ID NO: 9671 - protein, 468 aa, Nostoc punctiforme
MPANSWPEEDSYQELDPLNSLLSDLSVDEELVLETDPVSLPSRFQGRRGKAALVLTIVWSGTIALHLVSWASIFILGLTTILGFHALVVVFTKSRRYPKEIQGDLPFVSVLVAAKNEEAVIAKLVKNLCNLEYPGGQYEVWIIDDRSSDSTPHLLAELEQKYDQLKVLRRSAEASGGKSGALNQVLPLTKGGIIAVFDADAQVTPDLLQQVIPLFQREKVGAVQVRKAIANAKDNFWTKGQMAEMALDTWFQQQRTALGGIGELRGNGQFVRRSALESCGGWNEETITDDLDLTIRLHLDKWDIECVFHPAVQEEGVTNAIALWHQRNRWAEGGYQRYLDYWDLILKNRMGTRKSWDLLIFMLIMYILPTAAVPDLLMAIARHRPPMLSPITGLSISMSMVGMYTGLTRIRQDQKFSLSTYLTMLVQTLRGSLYMLHWLVVMSSTTARMSVRPKRLKWVKTLHTGHVE

SEQ ID NO: 9672 - protein, 272 aa, Zea mays
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEVYEYITYDANKHISLASLPGMQERTIITSSLSKTYKSDCVGDSVGLVQQQASLNPLRNIHIKLTDSAPCNCDDFG

SEQ ID NO: 9673 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 9674 - protein, 277 aa, Asparagus officinalis
ACENWGFFELLNHGISIELLDKVEGMTKGHYKKCMEQKFKEFAKQALERGEELDMISNMDWESTFFLKHLPQSNITGIPDLEDEYREVMKEFALELEKLAERLLDLLCENLGLEQGYLKNRFGGSNGPTFGTKVTNYPPCPRPELFKGLRAHTDAGGLILLFQDDKVTGLQLLKDANWVDVPPMTHSIVVNLGDQLEVITNGKYKSVMHRVVAQTDGNRMSIASFYNPGGDAVIYPAPALIKEEEEEKENEVTTYPKFVFEDYMKLYVAQKFQAKEP

SEQ ID NO: 9675 - protein, 457 aa, Chromulina nebulosa
YSVKETDVLVLFRITPQPGVDPIEAAAAVAGESSTATWTVVWTDLLTACDIYRAKAYFVEEVPNSSSEFFAFIAYECDLFEEGSIANLTASIIGNVFGFKAVKALRLEDMRIPYGYLKTFLGPATGVIVERERLDIFGRPLLGATVKPKLGLSGKNYGRVVYEGLRGGLDFLKDDENINSQPFMRWRERFLYVMEGVNKAAAKTGTVKGSYLNVTAATAEEMYERAEFAREVGSVIIMIDLIIGYTAIQSIAFWARKNDLVLHLHRAGHSTYTRQKTHGINFRVICKWMRMSGVDHIHAGTVVGKLEGDPSTVKGFYDTLLLTTLKENRAIGIFFDMDWASLRKCMPVASGGIHCGQMHQLVQLLGEDVVLQFGGGTIGHPDGIQAGATANRVALESMILAKNEGRNYTEEGPDILKAAAKECRPLQVALDLWKAITFNYASTDTLDFEATPTKSSS

SEQ ID NO: 9676 - protein, 218 aa, Brassica oleracea var. capitata
MKTFFLVTLLLAAAVCTHGREQVKDSNGNPVKRGAKYFIQPAKSNGGGLVPAAINILPFCPLGITQTLLPYQPGLPVSFGYEPVIVGTDYIYTSTTINIEFRSEIWPVCNELSKLWAVDVSSSAAKEPAIIIGGERTAPNSLFKIEEATGAHTYKLTTSSGTVGTIPGPWLGAPQLIATNDDAKTLFVKFVKVDDDATKATTSTSRVEKLGLRMFPFY

SEQ ID NO: 9677 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 9678 - protein, 113 aa, Glycine max
  unsure (1)..(113): unsure at all Xaa locations
MLLRAFAFLSARFFQLKYFLSFSHCNKKCSSQSFKVESPNLKYTXLTFMSMYYYETTELAHENIKGTYQRVDKPTTDEWEXKTNTHVPKLRVMLTGWWGNNVSTATAGVIANR

SEQ ID NO: 9679 - protein, 540 aa, Listonella anguillarum
MITHLVDSINELGKTKLISLHHEQAAAFAAGGVARATNNEQVGLALGTSGPGATNLITGIADCWLDSYPCIFITGQVNTYELKDKRPIRQQGFQELDIVSLVDSITKYSIQVKTVEQLLIEIQKAISIARSGRPGPVLIDIPMDLQRKELDITFDDIARLVVPSAEEEMNSGFFSVDNALKEAQKPLFIIGGGACAEVQFSAWQKKISSLGIPHVSSLKGSERTSNYPEYLGMIGAYGTRAANYAVQNADIIIVLGSRLDIRQTGANVADFARNAKKIIQIDVDKGQIDNRITTHLNIVSKCNSYFEHFLSEDYIINCSLWREKLKETFRKKFIDEYEAYRFSPFKIMQTLSEKFSGKIVHYIPDVGNHQMWLAHSLFIEPQQKIHHSGGLGAMGFSLPTAIGVRVVTGNYVVSISGDGGFQLNIQELDVINRDKIPILIIILNNKSLGMVKNFQDMYFNGRNKPTYWGGYSCSFSQVGEAYGIESHLIKNDLEFSALVESYVKNARPLLIEVSLEDVTVCKPRLVYGKSIDEQYPFDEQ

SEQ ID NO: 9680 - protein, 547 aa, ASPERGILLUS NIDULANS FGSC A4
MGGAGDTSAALDAAAQIRKVNLKASSGLPGLIQNKKVFGVAMFACLGGLLYGYNQGVFSGVLVMHSFEEHMGDAVTNETKKGWLTSILELGAWLGALYSGVLCERFSRKYTILAHVCIFCIGVVIQLTAAAGSGSSSNILGGRFVTGMGVGSLSMSVPMYNAEIAPPEVSFWINYGTNHIGGTGETQKDTAWLLPLALQLVPAVILGVGMIFMPFSPRWLVHHGREEEALKVLTSLRGLEADDPVLQLEFLEIKAQSVFEKRTEKERFPHLERSSLWSYLKLEAAGYKSLFTSWPMFKRVIVATVTMTFQQWTGVNAILYYAPTIFEQLGMSSNTTSLLATGVVGVAMFLATIPAVIWVDNVGRKPILLIGAIGMAACHFIIAGIFAENETQWESHRAAGWGAVAMVWLFVIHFGYSWGPCSWIIIAEIWPLSVRAIGTSLGASANWMNNFIVGQVTPDMLAGIRYGTYIFLGLMTTLGALFIFFFVPETKQVSLEEMDVIFGSEGTAVADHERQAEISREIGLDEALARFSTRSGATLAEVEPKNA

SEQ ID NO: 9681 - protein, 434 aa, Desulfovibrio vulgaris (strain Miyazaki) [sequence omitted]

SEQ ID NO: 9682 - protein, 243 aa, Bacillus licheniformis
MSYRVKRMLMLLVTGLCLSLSTFTAGASAQTGGSFYEPFNNYNTGLWQKADGYSNGNMFNCTWRANNVSMTSLGEMRLSLTSPSYNKFDCGENRSVQTYGYGLYEVSMKPAKNIGIVSSFFTYTGPTDGTPWDEIDIEFLGKDTTKVQFNYYTNGVGNHEKIVNLGFDAANSYHTYAFDWQPNSIKWYVDGQLKHTATTQIPQTPGKIMMNLWNGAGVDEWLGSYSGVTPLSRSLHWVRYTKR

SEQ ID NO: 9683 - protein, 344 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVGMGI

SEQ ID NO: 9684 - protein, 221 aa, Novosphingobium aromaticivorans
MRSQERRPLRRRARSRPCRHRTEVWPMILVIDNYDSFTWNLVHYLMEMGAEVEVVRNDALTAEQAIGTGAQGFLLSPGPCTPNEAGVSLDLVGAAADARLPLLGVCLGHQSIGQYFGGKVVRGGLMHGKTSPVEHDGTGVFEGLPSPFIATRYHSLIVTDIPDCLVVNARSDDTHVMGFRHRDLPIHGVQFHPESIATEHGHAMIANFLRICGIKTNPLPA

SEQ ID NO: 9685 - protein, 419 aa, Prionitis patens
DTDVLALFRVTPQPGVDPIEASAAVAGESSTATWTVVWTDLLTACDLYRAKAYKVDAVPNSSEQYFSYIAYDIDLFEEGSIANLTASIIGNVFGFKALKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGIWARKNDMILHLHRAGNSTYSRQKSHGMNFRVICKWMRMAGVDHIHAGTVVGKLEGDPIMIRGFYNTLLLTHLEVNLPQGIFFEQDWAALRKVTPVASGGIHCGQMHQLLDYLGDDVVLQFGGGTIGHPDGIQAGATANRVALEAMVIARNEGRDFVAEGPQILQDAAKTC

SEQ ID NO: 9686 - protein, 754 aa, Streptococcus agalactiae NEM316
MTRNFTTYVEQQGKVLSELTNEEIYVELLNFVKEEAAAKSKNSSQRKVYYISAEFLIGKLLSNNLINLGIYKDVKKELELVGKSIAEIEDVEPEPSLGNGGLGRLASCFIDSISSLGINGEGVGLNYHCGLFKQVFRNNQQEAEANYWIENNSWLVPTDISYDVPFRDFTLKSRLDRIDVLGYKKDTKNYLNLFDIDGLDYNLIEKGITFDKTEIKKNLTLFLYPDDSDKNGELLRIYQQYFMVSNAAQLLIDEAIERGSNLHDLAEYAYVQINDTHPSMVIPELIRLLTEKHGFEFDEAVSVVRNMVGYTNHTILAEALEKWPLEYLNEVVPHLVTIIKKLDQMIREEQTNPEVQIIDEAGRVHMAHMDIHFSTSVNGVAALHTEILKNSELKVFYDIYPDKFNNKTNGITFRRWLEFANQDLADYLKELIGDSYLTDATQLEKLLTYADSNEVHDKLAAIKFKNKLALKRYLKENKGIELDEYSIIDTQIKRFHEYKRQQMNALYVIHKYLEIKRGHFPSRKLTVIFGGKAAPAYTIAQDIIHLILCLSELINNDPEVNKYLNVHLVENYNVTVAEKLIPATDISEQISLASKEASGTGNMKFMLNGALTLGTMDGANVEIAELAGKENIYTFGKDSDTIINLYETSGYRSKDYYDKDKVIREAVDFIISDDIVSLGNAERLKRLHDELVGKDWFMTLIDLKEYIAVKEQVLADYEDYESWNKKVIHNIAKAGFFSSDRTIEQYNQDIWHSN

SEQ ID NO: 9687 - protein, 572 aa, Burkholderia fungorum
MRKVCRTGRRNTSPTAVEAFVAQAGKLPRVAANSRKNPCFATRQQKNRSAAARTVTDIHRIQEAVMLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCLGQLGLPVTESLPAHRLAAATGAAATA

SEQ ID NO: 9688 - protein, 316 aa, Zea mays
MAFNYHDHALAMDPAAAAAVGAAANPSFVSGGGMAGGPGWEREKAAIAAHPLYERLLEAHVACLRVATPVDQLPRIDAQIAARPPPMEAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNSASSSSDKSKRKRNTAGDGNAEPAW

SEQ ID NO: 9689 - protein, 856 aa, Magnaporthe grisea
MNPGPAPRPPTDRPRLNLTPSQNLPGNMANMSLNSPGMGRGQFGGGSSVYGGSTISLPLSRAASNTDGLGGVAVIKEGWAQVKESKNFINPWKQKYLILRKEALDFHKQEGSKSSYTLYLKDVINVGRVEAAGTIFEVKRQSNGTSTSPGEDDGTVRTLQIKVKSDDDLYEWIDFIYARCPGMGGVSNPTNFSHAVHVGFDPQTGEFVGLPPEWSKLLNSSAITKEDYERNPQAVFEVLDFYSDLTKRNDNPAQYSSLTPTPPAGAMPNKQLGYSTGANVAPPRQMQQQQQPMQRTNNYPNMSGGGLPPNASGARGPSPPDPQQQQRQQMQNMSSNYINQGDPNRDAERQRQAEAAQRQRMMEIEEQNRRDLEAYNASIPQTKKPIAQQEIGGYGGAPSSSADRFNPNRAPPPAPKPTAQQSNLQAQRPAPRAPNAAGGPRPGISQQNSSQNVRDPASQQQQRVPPRNDQSPNAQRYPNGGPAPQPRTNGQPQNQQPSRLPAPVKPLNVAPKPAAQSDAVRAAEAALTAKPPAQERQKDVRMSTMSETEVMAKLKEAVSKDDPNLSYSKQKKIGQGASGSVYVAKVKETAVSPIARELLREQGSRAQVAIKQMDLAHQPRKELIVNEIMVMKDSTHRNIVNYLDAFLRNNYSELWVVMEYMEGGALTDVIDNNPVITEEQISTICLETCQGLQHLHSQSIIHRDIKSDNVLLDARGNVKITDFGFCAKLTESKSKRATMVGTPYWMAPEVVKQKEYGPKVDIWSLGIMAIEMIESEPPYLNEEPLKALYLIATNGTPRLKNPAKLSKELKAFLSVCLCVDVKSRASAKELLEHDFLKHGCPLGSLSDLLAFKKHAK

SEQ ID NO: 9690 - protein, 385 aa, Lycopersicon esculentum
MANEEAEKKKNTSSSEAKQPLKTAKKKTLGWMEWLRGWFYLVYEMLFQRILASHLQNPMPLPPINDVTCIVTGSTSGIGREIARQLAEAGAHVVMAVRSTNRAQELIRKWQEEWSGKGLPLNIEVMELDLLSLDSVARFAEAWNARMAPVHVLINNAGIFSIGEPQKFSKDGYEEHMQVNHLAPAMLSILLLPSLIRGSPSRIVNVNSTMHYVGFVDPEDMNVVSGKRKYTSVVGYGGSKLAQIMFSSILHKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 9691 - protein, 314 aa, Glycine max
MMGRVMEKPSQDLLQQQQQALKCPRCESSNTKFCYYNNYSLSQPRHFCKACKRYWTRGGTLRNVPVGGGCRKNKRVKRPTNHGDSSSSAANSPSSSNSNPPSQPHIDNIIASSSTTNHINNISPFFYGGDVMSSVPFPRFNLHSQLNALGLGFSTGVSENGFSTSNNNSFFSAYNSMFGSSSSSTCAPSTPVMASLLSCTLLQQNFMGGGGGGVKGRDHDQGDNTFHGLAPLQGLRVEGDSNNNIGSKEVKGEGQNRFEWSNNNNNNNNNGGGGQNQMEHVGLSDPNSLYWNTATGLGAWSDQPNIGPSVTSLI

SEQ ID NO: 9692 - protein, 493 aa, Xanthomonas campestris pv. campestris str. ATCC 33913
MYRMLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLARKA

SEQ ID NO: 9693 - protein, 62 aa, Zea mays
MFLESFRVESPRVKYGDGEIQSEYRYDTTEVVPPGNGGGAGWVVRPKSVTYNFKTSTNVPKL

SEQ ID NO: 9694 - protein, 353 aa, Pseudomonas aeruginosa PAO1
MTLQIRGYAAQSASTPLTAHRFERRAPRADDLVIDILYCGVCHSDLHQARNEWHNSLYPLVPGHEIIGRVASVGEAVSGFAVGELVGVGCMVDSCRHCAACSEGLEQYCAEYPTLTYNGRDRHDGLPTFGGYSERIVVSARFVLRIPQGLDPKAAAPLLCAGITSYSPLRHWKVGPGSRVAVVGLGGLGHMGLKFARALGAEVALFTRSPGKEEEARRLGADQVILSTDPQRMAAVAGRFDLILDTVPHQHDLNPYLATLKRDGTLVLVGLLEPLEPAVHGAQLVMGRRSIAGSAIGGIAETQEMLDFCAAHGIACDIEMIEIQQINQAYERMLASDVKYRFVIDMASLQKSF

SEQ ID NO: 9695 - protein, 327 aa, Zea mays
MSFGTVGMEEEGGAAAAAEEIRRLPAEVNWEMLDKSRFFVLGAALFSGVSAALYPAVVVKTHLQVAPPPQAARATAAAILRRDGLRGFYRGLGASLGGTVPARALYMAALEATKSSVGSAAVRLGVSEPAASAAASAAAGVSAAVAAQVVWTPVDVISQRLMVQTPACCRYRGGVDACRKILVADGVRGLYRGFGLSILTYAPSNAVWWSTYVVAQRCLWRAVGPERSESCASLMAVQGASAAVAGGAAALVTMPLDTVKTRLQVMEADAARPTLASTVRGLLREGGWAACYRGLVPRWGSMSLSAATMVTTYEFLKRLSAKDGSLG

SEQ ID NO: 9696 - protein, 92 aa, Agaricus bisporus
PPGLVPLKKKAHFREALAYFSERRHSRLIMGTASCWFPLDIAFYGINLNQNVVLQQIGFDGSSGSAWNRLFKISTGNIIITALGFVPRPRPR

SEQ ID NO: 9697 - protein, 416 aa, GIBBERELLA ZEAE PH-1
MGDLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLQIWHDASDEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 9698 - protein, 267 aa, Glycine max
  unsure (1)..(267): unsure at all Xaa locations
GLFTPAAPPIAVFLGVTGISFVAFPLSKNFPLALAQALACGTVGAFLVDRIIRKQLGHLLVKSNTPXLRPKEDSVHHHNIGFLDDVAGPKGAQLEIVYGVFGYMQVLSACFMSFAHGGNDVSNAIGPLAGALAILQGGAAGTEIVIPTDVLAWGGFGIVAXGLMMWGYRVIATIGKKITELTPTRGFAAEFAAASGVLFASKLGLPISATHTLVGAVMGVGFARGLNSVRSETVKEIVASWVVTIPVGATLSVLYTWILTKILSYIL

SEQ ID NO: 9699 - protein, 193 aa, Arabidopsis thaliana; identical to SEQ ID NO: 417

SEQ ID NO: 9700 - protein, 406 aa, Brassica napus
MAAALQTNIRPVKFPATLRALTKQSSPAPFRVRCAAASPGKKRYNITLLPGDGIGPEVISIAKNVLQQAGSLEGLEFSFQEMPVGGAALDLVGVPLPEETVSAAKESDAVLLGAIGGYKWDKNEKHLKPETGLLQLRAGLKVFANLRPATVLPQLVDASTLKREVAEGVDLMVVRELTGGIYFGVPRGIKTNENGEEVGYNTEVYAAHEIDRIARVAFETARKRRGKLCSVDKANVLDASILWRRRVTALAAEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLGALNKGFRTGDIYSAGTKLVGCKEMGEEVLKSVDSHVQASV

SEQ ID NO: 9701 - protein, 493 aa, Schizosaccharomyces pombe
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 9702 - protein, 308 aa, Zea mays
  unsure (1)..(308): unsure at all Xaa locations
MAPSRPLMRGIRPPRVFPTRGGRASPYTVALTALLLVSAALLALIAFGVFSLPVSAPNAAATTGTAAGGETESADVRPRARRDLGEGLGERGAQWTEVISWEPRAFVYHNFLSKDECEYLIGLAKPHMVKSTVVDSTTGKSKDSRVRTSSGMFLQRGRDKVIRAIEKRIADYTFIPVDHGEGLQVLHYEVGQKYEPHFDYFLDEFNTKNGGQRIATLLMYLSDVEEGGETIFPDANVNASSLPWYNELXSDCAKRGLSVKPKMGDALLFWSMKPDATLDPLSLHGGCPVIKGNKWSSTKWMHIHEYKA

SEQ ID NO: 9703 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASATTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 9704 - protein, 307 aa, Escherichia coli
MGSTRKGMLNVLIAAVLWGSSGVCAQYIMEQSQMSSQFLTMTRLIFAGLILLTLSFVHGDKIFSIINNHKDAISLLIFSVVGALTVQLTFLLTIEKSNAATATVLQFLSPTIIVAWFSLVRKSRPGILVFCAILTSLVGTFLLVTHGNPTSLSISPAALFWGIASAFAAAFYTTYPSTLIARYGTLPVVGWSMLIGGLILLPFYARQGTNFVVNGSLILAFFYLVVIGTSLTFSLYLKGAQLIGGPKASILSCAEPLSSALLSLLLLGITFTLPDWLGTLLILSSVILISMDSRRRARKINRPARHE

SEQ ID NO: 9705 - protein, 306 aa, Bacillus subtilis subsp. subtilis str. 168
MRKKTVQIMISHSLMIGLWASAFPGIRAGLEGYTPEHLALFRLLIGSMALLLFAVLTQMRLPDLKDIPAIFLLGFLGFAFYHILLNIGEKTVSAGVASLLVTTAPIFSAMLSRLFYKEHFGFTKWLGSMISLLGVLLIAFGAGDFTYSMSGILVILLAAFSESIYFVFQARYIKKYGFIPFVTFTIWGGTIPMLVFLPGLGEEMMNASISATLSIVYLGLLPTVIPYFALAYVTSFVGASEATLSLYVTPALALIISWLWIGEIPTLLSLLGGVVTVGGVCFTYLKVNKMNKIFITHFSAKRVKKL

SEQ ID NO: 9706 - protein, 251 aa, Betula pendula
MGRGRVELKRIENKINRQVTFAKRRNGLLKKAHELSVLCDAEVALIIFSNRGKLCEFCSSPSMLKTLERYQKCNFGAPEPNVSAREALELSSQQEYLKLKARYEALQRTQRNLMGEDLGPLSSKELELLERQLNMSLKQIRSIRTQCMLDQLTDLQRKEHMLNEANRTLKQRLVDGYHIDTVLQLDQSANDVGYGRQPAQTQDDCFFHPLCEPTLQIGYQHDHPMTVVTAGSGSVVTAGPSVNNYMSGWMP

SEQ ID NO: 9707 - protein, 863 aa, Ajellomyces capsulatus
MRGGVLDLLPIAFASLAVATEHLTQSPPYYPSPWASGQGGWEDAVERARDFVSQLTLVEKVNLTTGVGWMQENCVGQVGSIPRMGLHSLCMQDGPLGFDLPDYVSAFPAGVNVGATFSKELAYLRGKAMGEEHRDKGVDVVLGPVVGPLGRSPDGGRNWEGFSPDPVNSGLLVAETIKGIQSAGVIACVKHFIGNEQERFRQGPEAQGYGFDISESSSSNIDDVTMHELYLWPFADAVRAGVGSVMCSYNQINNSYGCGNSYTQNKLLKAELGFQGFIMSDWQAHHSGVGSALAGLDMSMPGDTVFGTGRSYWGPNLTIAVANGTIPEWRVDDMAVRIMAAYFKVGREAAKVPVNFNSWTRDEYGYTHALVKEGYGKVNEKINVRAKHASIIRQVGAASVVLLKHTGSLPLTGLEKNVAVIGEDAGPNLWGPNGCPDRRCDNGTLAMGWGSGTADFPYLVTPAEAIQNEILFKGEGSVFPIFDNWASDQIKSAASQATVSLVFVNADSGEGFISVDGNEGDRKNLTLWKGGDELIQTVASHCNNTVVVIHSTGPVLVGEWNEHPNITAILWAGLPGQESGNSIADVLYGKVNPGGRTPFTWGRTAEDYGASILKEPNEGNGAPQVDFTEGIFTDYRAFDKADVKPIYEFGFGLSYTSFSYSDLNVEVVSSEPYMPTRGKTEPAPILGESDRNLSSYLFPEGTDRVTYYIYPWLNVTDPAKASMDSHYGLQKEDYIPPGATDGSPQELLPASGGPGGNPGLYEVLYRVTATITNTGSISGDEVPQLYVSLGGPNDAKVVLRNFDRFTLAAGEAKIWTSILSRRDLSNWDPVTQNWVISDYPKTVYVGSSSRKLLLSAPLVSNNY

SEQ ID NO: 9708 - protein, 927 aa, Avena sativa
MASKGAGAGGGGGGGDGYDEPQRPKQQLPRDSRGSLEVFNPSSSAVEPPSAFRPAARSASPFIEEVAGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALADGSNYCGRVLNYKKDGTAFWNLLTIAPIKDEEGRVLKFIGMQVEVSKYTEGNKDTAVRPNGLPESLIKYDARQKDQARSSVSELLLAIKNPRSLSESTNSTFKRKSQESVGPLTGDRPGKRSSESGSRRNSKSGARTSLQKISEVPERGNKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPVFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDGTDKGLGDATAAADNHTDMF

SEQ ID NO: 9709 - protein, 521 aa, Oryza sativa (japonica cultivar-group)
MAMADLELEKVASFLLAALLPLVLFKLAAAKRGGGDGGMRLPPGPWRLPVIGNLHQIMAGGQLVHRTMAGLARGLGDAPLLSLRLGEVPIVVASSADAAREIMSRHDAKFATRPWSPTVRVQMVDGEGLAFAPYGALWRQLRKITMVELLSPRRVRSFRRVREEEVGRLVVAVATAATRRPGEAAVNVGERLTVLITDIAVRTIIGDRFERREDFLDAAAEWVKIMSGFSLGDLFPSSRLASFVSGTVRRAEANHRKNFELMDYALKQHEEKRAAAAAAGAGAVEDDEDIVDVLLRIQKEGGLEVPLTMGVIKGVIRDLFGAGSETSANTLQWTMSELVRNPRVMQKAQTELRDCLRGKQSVSEDDLIGLKYLKLVIKETLRLHPVVPLLLPRECQETCNIMGYDVPKGTNVLVNVWAICRDPRHWENAETFIPERFEDSTVDFKGTDFEFIPFGAGRRMCPGLAFAQVSMELALASLLYHFDWELPSGVAPSNLDMEEEMGITIRRKNDLYLVPKVRVPL

SEQ ID NO: 9710 - protein, 339 aa, Synechococcus sp. PCC 7942
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 9711 - protein, 370 aa, Oryza sativa; identical to SEQ ID NO: 8995

SEQ ID NO: 9712 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 9713 - protein, 100 aa, Zea mays
ILCRFRFVDKCKYPEDGSPPRSLRYIGSMVADVHRTLLDGGIFLYPADQKSPDGKLRVLYEVFPMSFLMEQAGGQAFTGKQRVCFSFPFSDPNPQLKNLD

SEQ ID NO: 9714 - protein, 641 aa, Schizosaccharomyces pombe
MKIVDLIDKIPNGNAFYSFEYFPPKTTVGLENLSSRITRMSRNMMPLFSSVTWGTAGSTAEVSIYLAKMLEQHHKIPACLHLTCTNVDKAIIDKALETAKEYGIRNILALRGDPPLNSDHWEGKVSEFEHAVDLVRYIREKYGDYFCIGVAAYPEGHVDSNVPELSKDPLRDIPFLIEKVEAGADFIITQIFYEPEAFIKFENFVRNHSSNALRNIPIIPAIMPIQSYGSLKRMTRLCGCSVPSSLMQRLNAAKPDDEAIKNIGVEHIVDMIKKIMDNVQGRVHGFHFCTLNLERSVALILKNSGLLTKRWKQVESEMEDEKLLRTTRKRLSLDEPAELHNQVVVPSQQPVADKSSNLFVTSKQSSVSGHKDNLTEEAPFSVSEGSGVLGRQANWDDFTNGRFGDPRSPAYGEIDGYGPTLHFPPSEALKLWGYPVDESDITSLFQKHIMSDISAIPWIDEPVEVETKTIAKYLLKLNGNSWWTVGSQPAVNGAPSADPVFGWGPKGGRVFQKAFVECFVNGKDLKDFITKWHDNPQVTYYAGNNKSEFLTNAPKDGASAVTWGVYPGREIIQSTIIAEVSFKAWLSESFQVWGEWANLYSKNTPSRKLLENCLNDRWLVTVIHHDFMDKNGLWKVLEIDF

SEQ ID NO: 9715 - protein, 276 aa, Zea mays
  unsure (1)..(276): unsure at all Xaa locations
LQGEAAAAVAPQPALRPALAFHTTTTSXAPPRKPGPLAVGAQILRSEGAAGLFSGVSATMLRQTLYSTTRMGLYDILKTRWARENGGVLPLHRKILAGLVAGGVGAAVGNPADVAMVRMQADGRLPLAERRNYRGVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQ

SEQ ID NO: 9716 - protein, 648 aa, Glycine max
  unsure (1)..(648): unsure at all Xaa locations
KNEHLLRSGQLGMCNDPYCTTCPTYFNASQQRNPKPSTRWDPKFHNALYGDAKSFVRKLLSFCYSYVPGVMNPHAKVVQKWNKFLAIFCLIAIFVDPLFFFLLYVEKDNKCIVINWPLTTALVLFRCVNDFVYFLNILLQFRLAYVSRESRVVGAGDLVDHPKKIALHYLKGYFLIDLFVVFPLPQXKYVQIMILFVLPNSLEGANYAKNLLRAAILVQYIPKLFRFLPLLIGQSPMGFIFESAWANFVINLLIFVLASHVVGSCWYLFGLQRVNQCLRDACHSSNIPECMKFIDCGRGHGNNQPGLRSDQWINNTQAVACLDPSPDGFSYGIYENAVPLTIETNVVKKYVYSLFWGFQQISTLAGNLEPSYFVWEVLFTMAIIGMGLLLFAILIGNIQNFLQALGRWKLEMQLRGRDVEQWMSHRRLPEDLRRRVRRAERYNWAATRGVNEEMLMENLPEDLQRDIRRHLFKFVKKIRLFALMDEPILDAICERLRQKTYIKGSKILSQGGLVEKMVFVVRGKLESIGEDGTRIPLSEGDSCGEELLTWYLEHSSVSTDGRKVRLPGQRLVSNRTVRCLTNVESFSLSASDIEEVTILFTRFLRSPCVQGALRYESPYWRSLAATRIQVAWRYRKKRLSRVNSSPSD

SEQ ID NO: 9717 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEALPKLAANAASVA

SEQ ID NO: 9718 - protein, 531 aa, Zea mays
  unsure (1)..(531): unsure at all Xaa locations
MSSVGSGSGTRAANGAAAISAAATAAGSADARFHPQLLQQQDRQSRWAGCFSGLSCFGSQKGGKRIVPAARTSDGNGSNARGNGLQSGANSNQNMPMNLSLLAPPSSPASFSNSALPSTAQSPNCFLSVSATXPGGPTSNMFAVGPYANEPQLVSPPVFSTYTTEPSTAPLTPPPELAHATTPXSSPDVPYARFLSSSMGIKTASKDHNMPFLSTTYSGGSGLQTSYPLYPESPCSSLISPASVTPRTGLSSPIPEQEVPPAHWKTSRSACDTPYFRASPIPEQETTAQWKTSRSACDTPYARTSPTNIFGLDSSTPRNYMLDNNFFRPAASAQFYLDQAQQTFSHNGGRXSVSREKQGADEIEAYRASFGFSADEIVQSQSYVGIPDAVDESFSISPFGNNTPATGDLPIQXLPNEVQKVDKSCAYAKDDTSPKKSANQLSTDSPNKVLRLDVFKGTKGGHQSEDECIRKDGHLFRKTADEISLKPIEVRKKSLPGHSCSDAEIEYRRTRSLRDANGVLSRRSALARQLH

SEQ ID NO: 9719 - protein, 711 aa, Pseudomonas putida KT2440
MPSKKTDAPKHSEAAGTQTPDRANTNAKLQSLEADRSDATGQALRTNQGVRIADNQNSLKAGDRGPSLLEDFIMREKITHFDHERIPERIVHARGTGAHGFFQSYGNHAELTKAGFLQDPEKITPVFVRFSTVQGPRGSGDTVRDVRGFAVKFYTDEGNFDLVGNNMPVFFIQDAIKFPDFVHAVKPEPHNEIPTGGSAHDTFWDFVSLVPESAHMVMWAMSDRAIPRSLRMMEGFGVHTFRLINAEGVASFVKFHWKPRQGVHSLLWDEAQKLAGKDTDFQRRDLWEAIETGDYPEWELGVQIVPEADEHKFDFDLLDPTKIIPEELVPVTPLGKMVLNRNPDNFFAEVEQVAFCPGHIVQGIDFTNDPLLQGRLFSYTDTQISRLGGPNFHQIPINRPVAPNHNNQRDALHQHVVHKGRASYEPNSIDGGWPKETPPAAQDGGFESYQERIDAHKIRQRSESFGDHFSQARLFFHSMSPTEQQHIIKAYSFELGKVEREHIRAREVNEILANIDLKLAAAVAANLGLPAPKAGTVKVKGSQLAQSPALSQMNHPGSVGIKGRKIAVLVADGVDAASVDKLVKALEAHSARPMLLGPTSAPVKAADGKQLPVAASMEGMPSIMFDGIVVPAGKASTDALAASGLAKHFVLEGYKHLKALVLTKELAKALGLKEDKGLLLGDEQKAVDAFVKAVEGHRVWEREAAAEAVPA

SEQ ID NO: 9720 - protein, 201 aa, Mucor racemosus
TILKQDEGWIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEAF

SEQ ID NO: 9721 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 9722 - protein, 573 aa, Pseudomonas syringae pv. tomato str. DC3000
MRRRKRRLEKMTTTSRPLYISYAGPSLLEMPLLNKGSAFTPQERIEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMGNLLDFQLRLAQKSADVAGWTAGTETFPQLLDVVTHAGATVLIGVSGQRGLFTEQVVRELYKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLAAIERNFWLPGYRAYRRRSV

SEQ ID NO: 9723 - protein, 155 aa, Glycine max
  unsure (1)..(155): unsure at all Xaa locations
CVLQVNPADVIILEGILVFHDPRVRALMNMKIFVDTDADVRLARRIKRDTADNAREIGAVLDQYSKFVKPAFDDFILPTKKYADIIIPRGGDNHVAIDLIVQHIRTKLGQHDLCKIYPNLYVIQSTFQIRGMHTLIRDSQTTKHDXVFYSDRLIR

SEQ ID NO: 9724 - protein, 358 aa, Zea mays
MAGIRLLPEEPETTPQQQARAAAAVTTTTTDSLASDDDRSIAADSWSIKSEYGSTLDDDQRHADAAEALSSANFRVSSDYSSDKEEPDADGGGQSMLGLQSYWDAAYSDELTNFREHGHAGEVWFGDDVMEIVTSWTKDLCVEISQRNMSVSENDVTTEVNDQADKYLSSWNVLDLGTGNGLLLHQLAKEGFSDLTGTDYSDGAVELAQHLSQRDGFPNIRFMVDDILDTKLEQQFKLVMDKGTLDAIGLHPDGPVKRVMYWDSVSKLVAPGGILVITSCNHTKDELVEEVENFNIRKSNLCRGDGNDANNVLSSGSEAASRIDQPPFEYLSHVRTYPTFMFGGSVGSRVATVAFLRK

SEQ ID NO: 9725 - protein, 281 aa, Physcomitrella patens
MGRGKIEIKKIENTTSRQVTFSKRRGGLLKKAHELAVLCDAEVALVIFSSTGKHFEFASSGSMRDIIERYRKNSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGRLSEQQIPSTEEGCAGESSLKWDHPHFHIPNRLHANISPSVRTYKLHVDR

SEQ ID NO: 9726 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITTGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 9727 - protein, 386 aa, Lycopersicon esculentum
MADMNQHPTVFQKAANQLDLRSSLSQDVHARYGGVQPAIYQRHFAYGNYSNAGLHRGQATQDLSLITSNASPVFVQAPQEKGFAAFATDFLMGGVSAAVSKTAAAPIERVKLLIQNQDEMLKAGRLSEPYKGIGDCFGRTIKEEGFGSLWRGNTANVIRYFPTQALNFAFKDYFKRLFNFKKDRDGYWKWFAGNPASGGAAGASSLFFVYSLDYARTRLANDAKASKKGGERQFNGLVDVYRKTLKSDGIAGLYRGFNISCVGIIVYRGFYFGMYDSLKPVLLTGNLQDSFFASFALGWLITNGAGLASYPIDTLRRRMMMTSGEAVKYKSSLDAFSQIVKNEGPKSLFKGAGANILRAVAGAGVLAGYDKLQVLVLGKKYGSGGA

SEQ ID NO: 9728 - protein, 140 aa, Zea mays
  unsure (1)..(140): unsure at all Xaa locations
NREFKEKNKVDKIVVLWTANTERYSNVCAGLNDTMENLLASVDKNEAEVSPXTLYAIACVMEGVPFINGSPQNTFVPGLIDLAIKNNCLIGGDDFKSGQTKMKSVLVDFLXGAGIKPTSIVSYNHLGXNDGMNLSXPQTF

SEQ ID NO: 9729 - protein, 359 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLLQELKLACKNIYAEDLFIRMERHILDTLDWDISIPTPASYIPVLDPIFFLVLDASMFVPNLFKFPASKIACSVMNIVNEHVGSFLLTHPSMESYRKDDNFLWPEDLDTVTSYMENMSKRYANEECTDLLFSSLGRISSILAKKYPEQCAMAAWCNMTEKDTERTL

SEQ ID NO: 9730 - protein, 331 aa, Campylobacter jejuni subsp. jejuni NCTC 11168
MKKAKSRIAILGTGGTIAGFIDSTIATTGYAAGAIDIDVLIKAVPQIRDLADISWEQIANIDSSNMCDEIWLRLAKKIAKLFAEGIDGVVITHGTDTMEETAYFLNLTIKSDKPVVLVGAMRPSTAISADGPKNLYNAVALVVNKEAKNKGVMVAINDKILSARGVVKTHSLNVDAFSSPDFGDLGYIVDGKVFFYNNVIKAHTKNAPFDVSKLTSLPKVDILYSYSNDGSGVAAKALFEHGTKGIVVAGSGAGSIHKNQKDVLKELLKKGLKVVVSSRVVAGCVAVSDSDEKLGFISAEDLNPQKARVLLMLALTKTSDPKKIQEYFLKY

SEQ ID NO: 9731 - protein, 500 aa, GIBBERELLA ZEAE PH-1
MSDLYVNLEAPNGVKYRQPTGLFINNEFVPGSSTQKITSIDPATEKEIATVHAANADDVDKAVKAAYDAFRNPSWKKLPPPQRGVLMNKLADYIEERTKIFATSEAWDNGKVYTDAEGGDVVEVINTIRYYAGWADKITGQTITANPNKLAYTLRQPLGVVAQIIPWNYPLAMAAWKIGPALACGNTIVMKAAEQTPLSILLLGEAIKAVGFPPGVFNALNGYGSEAGPALVEHPLVDKVAFTGSTATGARIMEMASKTLKNITLETGGKSPLLVFSDSDIDEAVKWSHMGIMSNQGQICTATSRLLVQDKVYDEFVQRFIETTKTVSKVGHQWDSETYQGPQVSKQQYDRILEYIQIGKSEGATLLAGGQPVDSSKKGFFIQPTVFGDVHHQMRVFREEIFGPVVVITKFSDEAEALKLANDTTYGLGAAVFTKDVERAHRVAAEIEAGMVWINSTQDSEPYIPFGGVKQSGIGRELGEAGLEAYSNTKSIHVNLGSRL

SEQ ID NO: 9732 - protein, 391 aa, Dechloromonas sp. RCB
MLFVLLGAIMVLAMHAGFAFLEVGTVRKKNQVNALVKILSDFGVSTVAYFFVGYTIAYGVNFFSGVETLLQKSGFELTKFFFLLTFAAAIPAIISGGIAERAKFHPQLIATFLLVGFVYPFFEGIAWNQAFGIQAWLKASFGEEFHDFAGSVVVHAMGGWIALPAVLLLGARYGRYNKDGRISAHPPSSIPFLALGAWILIVGWFGFNVMSAQTLDKISGLVALNSLMAMVGGTLVALVAGKNDPGFLHNGPLAGLVAVCAGSDLMHPIGALVVGGVAGGLFVVMFTLVQNRWKIDDVLGVWPLHGMCGAWGGIAAGIFGSKAFGGAGGIAFMPQLIMTLMAIAVALVGGTLVYGALKATLGLRLDKEEEYEGADLSIHRITATPEREPNW

SEQ ID NO: 9733 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 9734 - protein, 159 aa, Glycine max
MGSEGSTVVVPRNFRLLEELERGEKGIGDGTVSYGMDDADDIYMQSWTGTIIGPPGTVHEGRIYQLKLFCGKDYPDNPPTVRFQTRINMTCVNQETGVVEPHLFPMLANWQRECTMEDILMQLKKEMISPQNRKLAQPPEGNEDGRIDQKGLALRCCVM

SEQ ID NO: 9735 - protein, 406 aa, Glycine max
  unsure (1)..(406): unsure at all Xaa locations
MVLEATMICIDNSEWMRNGDYSPSRFQAQADAVNLICGAKTQSNPENTVGVLTMAGKGVRVLVTPTSDLGKILACMHGLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFXAAAAAAAAAGGVSXFEFGVDPNLDPELALALRVSMEEDRAKQEAAAKKAAEDAAKQEKGGEQQASSQDATMTERASAAMSEAENKTSDLMDDENALLQQALAMSMDDPAISHDVKDTDMSEASASDPDLALALQLSIADSTKDQGSQSDMSKLLADQSFVSSILASLPGVDPNDPSVKDLLASMQNQSEPQQKNDDKPSNEEEKK

SEQ ID NO: 9736 - protein, 343 aa, Saussurea medusa
MALLVSSWSNGVQSVPKDYVMPPERRPGDFVSACNEIPVIDLQENPKIDRSDIVQQILKACQEFGLFQVINHGVSEKMMEDMRVLYHEFFNMPVDDKLRGYFEPWSTTGCSLYTSGVNYAKEDVHYWKDTLRHPCHPLEEHTPSWPEKPARYREEVGRYAVEVRKMGFKILDLIGEGLGLNEGYFNGVNQYQTMAINHYPLCPDPGLAMGIDGHTDPNLITFLQQDQYGLQMCKDGKWMGIDPIPNAFVVNIGYQLEIISNGKLKSAEHRVVTSSTTARTSIVTFFGPNAGLPIVVEPAKELVTSTSPKMFKSYQYNNFIADYLAYIRKPFPPSGTPLDPYRV

SEQ ID NO: 9737 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQADRSLGQKIASHLNLKPSI

SEQ ID NO: 9738 - protein, 367 aa, Hyacinthus orientalis
MGDPVTFQFFPVGEPEEEESPGGESTVAAGGAPRGHWAEVKFVEKEADVSPAIKKSRRGPRSRSSQYRGVTFYRRTGRWESHIWDCGKQVYLGGFDTAHAAARAYDRAAIKFRGVDADINFNLSDYNEDLKQMMNLAKEEFVHILRRQSTGFSRGSSKYRGVTLHKCGHWEARMGQFLGKKAYDKAAIKSSGREAVTNFEPSSYEREVLTEADSDAIGHDIDLNLRISQPNVSSPKRRDNPVGVQFHLGSFESSDAKKAMIDTHSSILVGQPHTAAMTSEASRVWSALYPGFYPPIELRAKDKMSMVGSAALPNWTWQLHGPMPSPMFTSAASSGFATTHATSSITPPASHHLQFPPPPNTNYYSRS

SEQ ID NO: 9739 - protein, 209 aa, Enterococcus faecium
MTKSKPIIIGVTGGSGSGKTSVSRAIFNNFPDHSIMMLEQDSYYKDQSHLSFEERLNTNYDHPFAFDNDLLIQHVGDLLNYKAIEKPVYDYVAHTRSQATIIQEPKEVIILEGILILEDERLRDLMDIKVYVDTDDDIRIIRRIKRDMEERGRTLDSVIEQYLTVVKPMYHQFIEPTKRYADIIVPEGGENHVAIDLITTKVASFLNHK

SEQ ID NO: 9740 - protein, 340 aa, Mycobacterium tuberculosis CDC1551
MVELSPDRIMAIGGGYGPSKVLLTAVGLGLFTELGDEAMTAEAIADRLGLLKRPAIDFLDALVSLDLLARDGDGPGSHYRNTPETAHFLDEARPTYAGGLLKIWNERNYRFWADLTEALKTGKAQSEVKQTGRPFFEALYADPRRLEAFMAAMDAASRRNIELLAKRFPFERYRRLCDVGCADGLLSRIVAAAHPHLQCVSFDLPAVTEIARRKLTAEGLGERVQACAGDFLADPLPAADVITMGQILHDWNLDRKQQLVAKAYEALSKEGAFIVIETLIDDARRENTTGLMMSLNMLIEFGDAFDYSAADFRGWCGEAGFRSFEVIPLAGGSSAAVAYK

SEQ ID NO: 9741 - protein, 428 aa, Methanosarcina barkeri
MSYIGLQQDSGEYKIQKIHAREILDSRGNPTVEVDVFTPKGFGRAGVPSGASTGTNEALELRDADPNRYGGKGVLTAVKNVNTIIQKELLGLDVRNQREIDELMIELDETDNKSNLGANAILGVSMAVARAAADSLNVPLYRYLGGSNAFTLPVPTMNVLNGGKHAGNDLAIQEFMIQPKGAETFYEALQIGAEIYHVLGKILEKKYGRSSTNVGYEGGYAPKMSESTEALDALAQAIEEAGYTDTEVTIGLDAAASEFYEDEAYAIDGKKLSAPELMDYYVELVNSYPILSIEDPFYEEAFEDFEALTNELWDTIIVGDDLFVTNIERLSKGVDMGAANALLLKVNQIGTISEAFDAANMASRNGYTVIVSHRSAETEDTTIADISVAIGAEMIKTGAPARGERTAKYNQLLRIEEDLGEVAHYVQL

SEQ ID NO: 9742 - protein, 274 aa, Glycine max
MSATVTLTLNLCRSSIVASCPHYNHKPNPNFNALFSFSLSLSLSHHRRIAICKKPFSSRRTWLHGHMKRDRDYELENGLALFGSDEELATQIPTQAQSLVEGSGSIRVAEFKPVPDVDYLQELLAIQQQGPRAIGFFGTRNMGFMHQELIEILSYAMVITKNHIYTSGASGTNAAVIRGALRAEKPELLTVILPQSLRKQPPESQELLSKVKNVIEKPHNDHLPLIEASRLCNMDIISHVQQVICFAFHDSRLLMETCQEAKNLRKIVTLFYLD

SEQ ID NO: 9743 - protein, 170 aa, Trichodesmium erythraeum IMS101
MELKNLIREIPNFPKSGIIFRDITTLLSNTDGLHYTIDILTEKCLEFKPDYVVGIESRGFIFGMPLAYQLNVGFIPVRKPGKLPAEVYSVSYDLEYGQDSLEVHQDAMPAGSRVLVIDDLLATGGTAGATTQLIEKAKCNLVGFAFVIELKELGGREKLPKVPIISLIEY

SEQ ID NO: 9744 - protein, 570 aa, Neurospora crassa
MVAQQQGKFTVGDYLAERLAQVGVRHHFVVPGDYNLILLDKLQAHPDLKEVGCANELNCSLAAEGYARANGISACVVTYSVGALSAFNGTGSAYAENLPLVLISGSPNTNDPSQYHILHHTLGHPDYTYQYEMAKKITCCAVAIPRAIDAPRLIDRALRAAILARKPCYIEIPTNLAGATCVRPGPISAITDPITSDKSALEAAAKCAAEYLDGKLKPVILVGPKAGRAGSEKELIEFAEAMGCAVALQPAAKGMFPEDHKQFVGIFWGQVSSDAADAMVHWADAMICVGAVFNDYSTVGWTAVPNIPLMTVDMDHVTFPGAHFSRVRMCEFLSHLATQVTFNDSTMIEYKRLKPDPPHVHTAEREEPLSRKEISRQVQEMLTDKTSLFVDTGDSWFNGIQLKLPPGAKFEIEMQWGHIGWSIPAAFGYALRHPDRHTIVLVGDGSFQVTAQEVSQMVRFKVPITIMLINNRGYTIEVEIHDGSYNKIKNWDYAMLVEAFNSTDGHAKGLLANTAGELADAIKVAESHKEGPTLIECTIDQDDCSKELITWGHYVAAANARPPRNMSVQE

SEQ ID NO: 9745 - protein, 87 aa, Oryza sativa
PAVNSSDSSHIVHVPPGENALSDVLISTPIFTGEEGGSGFASFSFSFLFFLSFFPFPSPFPLFLSFSLLFYLFSFFSSFILSFFFFI

SEQ ID NO: 9746 - protein, 452 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKTYYGFAVQICGGSHVSKAT

SEQ ID NO: 9747 - protein, 220 aa, Zea mays
  unsure (1)..(220): unsure at all Xaa locations
MSATSKAAIREMDARMFGLENPLVAALHHLLDVPHTPRITIRNELIPNQHSKSATSKAATREMDARMFGLETPRVAXALHHLLDVPDGDKAGGGATRXTYVRDARAMAATPXADVKELAGAYAFVVDMPGLXGTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 9748 - protein, 478 aa, Microbulbifer degradans 2-40
MKTEFDEDWLEWINTNVNNGQDKNGIFKILLDEGYAFEAIERVMNFRPTVPVDQLINPFKRAASPQQTVNNQNLQTAANHGAPTDPRKIFIPNALKLNSDKLEMYALGEFLTTEECERIIANIRSKLRPSELSSQESDKTYRTSRTCDLGTIDDPFIHYVDSRICKLVGIDPSYSEVIQGQLYEVGQEFKAHTDYFEIKEMPEHGAVMGQRTYTVMIYLNDVEEGGETDFPAADGAIKPRAGLALIWNSLQSNGAPNPHSMHQAYPVLKGHKAVITKWFRSQSRLPNAPPMYSKEANEYIPNYTASGLHKSTLNPALFQKLTQFYTDNKQQLTEEHVPGDFIENASKTCKKSSSLIDLSDELRQAVHDELKPKMEAWCNQPLAPTYVYGIREYHRGAKLKMHRDRLETHIISAIINIAQDVDEDWPLVIEDNAYRVHHILLKPGEMVFYEGGRLLHGRPIPFNGDSFANIFCHFKPES

SEQ ID NO: 9749 - protein, 209 aa, Streptococcus agalactiae 2603V/R
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQEPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 9750 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPARYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATPGTAPKYAGQDKVNPGSIILSAEMMLRHMGWTEAADLIVKGMERAINAKTVTYDFERLMEGAKLL

SEQ ID NO: 9751 - protein, 242 aa, Malus x domestica
RVELKRIENKINRQVTFAKRRNGLLKKAYELSVLCDAEVALIVFSNRGKLYEFCSSPSILQTVDRYQKCSYGAVDQVNIPAKELESSYREYMKLKGRCESLQRTQRNLLGEELGPLNTKELEQLERQLEASLKQVRSTKTQYMLDQLSALQNKEQLLIEANRDLTMKLDEIGSRNQLRQSWEGGDQGMAYGTQHHHAQSQGFFQPLDCNPTLQIGYPAEGSEQMGATTHAQQVNCFIPGWML

SEQ ID NO: 9752 - protein, 457 aa, Padina australis
  unsure (1)..(457): unsure at all Xaa locations
DYNVKETDILALFRITPQPGVDPVEAAAAVAGESSTATWTVVWTDLLTACDIYRAKAYRVDPVPGTNDQFFAYIAYECDLFEEGSLANLTASIIGNVFGFKAVKALRLEDMRIPFAYLKTFQGPATGVIVERERLDKFGRPLLGATVKPKLGLSGKNYGRVVYEGLRGGLDFLKDDENINSQPFMRWKERFLYCMEGVNRSAAATGEVKGSYLNVTASTIEQMYERAEYAEDIGSVIVMIDLVIGYTAIQTMAIWARKAQMILHLHRAGNSTYARQKNHGINFRVICKWMRMSGVDHIHAGTVVGKLEGDPLMVKGFYNTLLLTELKVNLAEGLFFDMSWASLRKCVPVASGGIHCGQMHQLLYYLGDDVVLQFGGGTIGHPDGIQSGATANRVALEAMVLARNEGRDYVAEXPEILRTAAATCAPLKTALDLWKDITFEYTSTDTPDFVEVPTGSK

SEQ ID NO: 9753 - protein, 457 aa, Sphacelaria yamadae
DYNVKDTDVLALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATGLVVERERLDKFGRPFLGATVKPKLGLSGKNYGRVVYEGLRGGLDFLKDDENINSQPFMRWKERFLYCMEGVNRAAAATGEVKGSYLNITAATIENMYERAEFAEEVGTVICMIDLVIGYTAIQTMAIWARKAQLILHLHRAGNSTYARQKNHGINFRVICKWMRMCGVDHIHAGTVVGKLEGDPLMVRGFYNTLLLTELKVDLAEGLFFDMDWASLRKCVPVASGGIHCGQMHQLLYYLGDDVVLQFGGGTIGHPDGIQSGATANRVALEAMVLARNEERDYVSEGREILRTAASTCGPLKAALDLWKDITFEYTSTDTPDFVEVATEAK

SEQ ID NO: 9754 - protein, 200 aa, Buchnera aphidicola str. APS (Acyrthosiphon pisum)
MANILLLDNIDSFTYNLVEQLRNQKNNVLVYRNTVSIDIIFNSLKKLTHPILMLSPGPSLPKHAGCMLDLIKKVKGDIPIVGICLGHQAIVEAYGGIIGYAGEIFHGKASLIRHDGLEMFEGVPQPLPVARYHSLICNKIPEKFVINSYFEKMIMSVRNNCDRVCGFQFHPESILTTHGDQILEKIIHWASLKYITNKKQ

SEQ ID NO: 9755 - protein, 391 aa, Trichodesmium erythraeum IMS101
MEFAKKLEKISPYPLTEINRKKNELIDRGVDIINFGAGDPDQPTPNHIVQAMHEAIKDSTNHHYPPIKGLKEYRQAAADWMKRRFGIEDLNSETEVISSIGSKESIHNLFLAFVNPGDYAIIPDPGYPVYRTSTIFTLGQPYSMQLRAENGFLPILSNIPQEVAEKAKLLWINYPNNPTGATASLEFFEELVGFCKHYDILLCHDNAYSEIAYDNYKPPSILQVPNAKDIAIEFHSLSKTYNMSGWRIGFVAGNSLGIKGLSQVKSNIDSGVFQAIQKAATEAFVSTTEKHLQSLVAVYQKRRDILIKGLQSLGYPIKANLASLYAWVPVPKNYTSQEFATLLLEKCGIIVVPGNAYGTSGEGFIRIALTVEDKRISQALQRIKDSGLNYI

SEQ ID NO: 9756 - protein, 469 aa, Thermoanaerobacter tengcongensis
MNEIGLIGLAVMGQNLALNIARKGYSVSVFNRTSEKTKEFLEERVKNEKIEGYHDIKSFVESLKKPRKIILMVKAGKPVDDVIQELLPYLEKGDLIIDGGNSYFKDTSRRIKELKEKGILYLGMGVSGGEAGALHGPSLMPGGSIEAYEMVKDVLLKIAAQTESGPCCTYVGNDSAGHFVKMVHNGIEYAIMQAISEVYDIMRKILKFSPEEIGDVFERWNNGELNSFLMEISFKIMRYKDEETGKHLVDLILDEAEQKGTGKWTSQTALDLGIPTPSLSLAVEARSLSFFKEDRVKLSGKVKKTYPDVKLDKEKVIKDLENALLFSVFTSFSQGLWLIHEASKTFEYNIDLPEVLRIWKGGCIIRAKILDFLREILNENKENVNLLDSDKSISFLMDKLDSIRYVTNLAKEFYIPTLVLSSSLDYFLSMVEGNLPANLIQAQRDFFGAHTYRRIDKEGIFHTEWEPID

SEQ ID NO: 9757 - protein, 390 aa, Bacillus pseudofirmus
MVIPELFSAGLILLLLFITGFVGMKMKIPDVVIFILLGIAVGGLLSGSHLLHFAGEVGIVLLFFMLGMEFPLKQLMSIAKKVLRAGILDVALSFGVTMAICMMMGLDVITSLIIGGVAYATSSSITAKMLESSKRMANPESEFMLGLLIFEDLVAPILVAVLVGLTAGMALTAGSMSLLVVKVVALVAGAVILGVFLFRKLGSFFDRHMKHDLFILFVIGLALMYGGLALYLDLSEVLGAFLAGIMLAEVKRTHELELMVVRFRDLLLPLFFLYFGTTISFSEGIPMIPLLILVLVWSVIAKVIVGVLGGRWYGLTKKVSLRAGLSLTQRGEFSIIIASLAAGSIKAFSSVFILASAMIGILLFQFAPSIANKFYGKKAKTSVKQHVGSA

SEQ ID NO: 9758 - protein, 77 aa, Oryza sativa
MAKHHPDLIMCRKQPGIAIGRLCEKCDGKCVICDSYVRPYAYYCKECTQQEKDRDGCPKIVNLGSAKTDLFYERKKY

SEQ ID NO: 9759 - protein, 485 aa, Gigartina radula
SVEERTRIKNERYESGVIPYAKMGYWDPDYLVKDTDVLALFRVSPQPGVDPVEASAAVAGESSTATWTVVWTDLLTACDLYRAKAYKVDLVPNTTDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEAVNRSIAASGETKGHYLNVTAATMEEMYERAEFAKQLGSIIIMIDLVIGYTAIQTMAVWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 9760 - protein, 570 aa, Ralstonia metallidurans
MGKKVAEIIVEVLEQAGVKRCYGIVGDTLNLIAEHLDRSSIDWVGVRHEEAGAFAAGAEALYTNNLTACAGSCGPGSLHFINSLYEANRNRAPVVLIASQVAMSEMGFEFIQEVDFKSVFKECSVFCDMILTPEQARRKTAMACQTALTRRGVAVLIVPVDISHGEVKEDFPYRVHHSRPSIRPNDAEIGAIAEVLNAGRKTAIYAGSGCEQALAEIMAVAERLKAPVAHTSRAKNWLEPGNPYNIGMTGILGNEAGYNAVLECDTLLLLGADFAWRQFYPDGAKIVQIDIDPTHLGRRHPITLGAVGDIQTTLQALLPHLDQHEDASFQEKYIKRYAEAMVAARKPLIPGHNDSIPGSYLASIIDKHAADDALICADDGSPIVWALRLFDANGKRQIFGSLLHGTMASALPSALGLQKACPDREVIAMCGDGGITMLFGELLTTIQEEVPIKIVVFDNSKLGFVEIEQKAEGMLDTFTKLKNPDFGKVAEAIGLWGKTVRKASELDASVQEWLSQPGPALLNVIVNPLELVKPPFLEAGPVIGMAMYSVRAILNGRGADVLEMVRENFR

SEQ ID NO: 9761 - protein, 449 aa, Glycine max
KIIPVDLLGSLLPRHLQILYEINFKFMEELKKKIGLDYNRLSRMSIVEEGAVKSIRMANLSIVGSHAVNGVSKLHLDTLKMNTFKDFYELWPEKFQYKTNGVTQRRWIVVSNPSLCALISKWLGTEAWIRNADLLTGLRDLVDNTDFHQEWKMVKKVNKMRLAEYIETMSGVKVSLDAMFDVQVKRIHEYKRQLLNILGIIHRYDCIKNMDKNDRRKVVPRVCIIGGKAAPGYEIAKKIIKLSHAVAEKINNDTDIGDLLKLVFIPDYNVSVAELVIPGADLSQHLSTAGHEASGTGSMKFMMNGCLLLATADGSTIEIIEEIGSDNLFLFGAKVQEVAELREKGSTLKVPLQFARVLRMVRDGYFGHKDYFESLCDTVEIGNDFYLLGPDFGSYLEAQAAADKAFVEPEKWIKMSILSVAGSGRFSSDRTIQDYAERTWKIDPCRCPL

SEQ ID NO: 9762 - protein, 170 aa, Helicobacter pylori
GSGMHTHVSVWKNNENLFSGEIYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9763 - protein, 479 aa, Zea mays; identical to SEQ ID NO: 6826

SEQ ID NO: 9764 - protein, 366 aa, Brassica napus
MFKQESNNIGSEENNTGPRACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 9765 - protein, 705 aa, Oryza sativa
  unsure (1)..(705): unsure at all Xaa locations
LGDLRFEPLERVRYTRDQLVELHEIIDIPENILKLKQDIDIELHGEDEPWINNDSSVQTQSYNRYAETDNRDWRSRIEQPVQTPAIGGEEKSWDKFREAKESYNQVGPAPALVKAEVPWSIQRGNLSNKERVLKTVKGILNKLTPEKFDLLKGQLIEAGITTADILKDVISLIFEKAVLEPTFCXMYAQLCFDLNEKLPSFPSEEAGGKEITFKRVLLNNCQEAFEGADNLRSEVNKLTGLDQEMERRDKERRVKLRTLXNIRLVGELLKQKMVPEKIVHHIVQELLGSESNRCPAEENVEAICQFFNTIGKQLDENPKSRRFNDVYFNRLKDLTTNSQLASRLRFMARDVLDLRSNQWVPRREEMKAKKFSEIHREAENNLGLRPGSTASIRTGRTGTGGGGPLSPGAFSMNQPGIVGMLPGMPGARKMPGMPGLGSDDWEVPHSRSKPRADPVRNLTPSLANKPSPNNSRLLPQGSAALISGKTSALVGSGGPLSHGLVVTPSQTTGPPKSLIPAPSVDPIVEQPAAAPKPSSTELQKKTISLLXEYFHILLLHEAQQCIEELKSPDYYPEVVKEAINLALDKGTNSIDPLLRLLEHLYNKNVFKATDLETGCLLYSSLLDELAIDLPKAPVHFGEVIGRLVLSHCLSIEVVEDTLKKIEDSFFRAAVFEAMMKIMKANPSGQAILGSHVAKIDACSKLLSSE

SEQ ID NO: 9766 - protein, 299 aa, Oryza sativa (japonica cultivar-group)
MDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 9767 - protein, 749 aa, Neurospora crassa
MMARKQATEAPAVSNGSPKKRSSADSDNHNVKRPRLQESTDKARWRLSSEGGRHTWHYLEDDEAAKEWPQSYADKYFLGMPLELPELPKATNPLDAVRNGLTFFEKLQLPEGHWGCEYGGPMFLLPGVVIARYVTKNPVPWYYATEIKNYLFARANPVDGGWGLHIEGESTMLGTTLNYTTLRLVGVEADHPVMVKARATMHKMGGAIYAPHWAKFWLTVLGIMKWDIVNPVPPELWLLPDWVPIAPWRWWIHMRQVFLPMSYLWSKKWQAEETDLIRELRNELFVEDWNKIDWAGNRNTIHPNDNYHPKTAFLNTVNWLLVNIWNPVFRTKYLVEKAEAWASELIDMEDENTDYSDLAPVNAAMNTVCCYVRDGPGAYSVRRHVERLDEVLWVNAEGMLCNGTNGVQCWDTAFAIQAIMDAGLTEDPRWRPMLIKSLEFLEDQQIRENVKDQDKCYRHPRKGAWAFSNKDQGYAVSDCVSEALKSVIILQKTPGFPTLIDDQRIFDAVDTMLTYQNPSGACSSYETPRAGQWMEVLNAAEVFGNIMVEYEYPECTTAVLTTLSLFKKHWPNHRTAEIDNFITRAVKWIKSNQKPHGGWYGNWGICFTYATMFALESLASVGETYENSRYAKKGCDFLVAKQREDGGWSESYKACETGEYVEHPTGSQVVMTAWALVGLIKAKYPNNDPIKKGIKLIMDRQQPNGEWRQEAIEGVFNKSCMISYPNYKFSFPLKALGLFATRYPDEKVV

SEQ ID NO: 9768 - protein, 126 aa, Zea mays
MADPELEAIRQRRMRELQHGAANQQNAGQQKAQEDAKQEAEERRQMMLAQILSSEARERLSRIALVKPDKARGVEDVLLRAAQTGGISEKVSEERLISLLEQINSHTSKQTKVTIQRRRNVLDDDD

SEQ ID NO: 9769 - protein, 337 aa, Ajellomyces capsulatus
MVVKVGINGFGRIGRIVFRNAIEHGEVNVVAVNDPFIETHYAAYMLKYDSTHGQFKGTIDVNSNGLTVNGKAVTFYQERDPASIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 9770 - protein, 424 aa, Brassica rapa
MATPMVEDTSSFEEDQLASMSTEDIVRATRLLENEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 9771 - protein, 145 aa, Triticum aestivum
  unsure (1)..(145): unsure at all Xaa locations
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 9772 - protein, 316 aa, Methylomonas aminofaciens
MANLFDQLKEFTTIVADTGDVEAIKSVKPYDATTNPSLLLKASTLPQYAPLIDEAIAYAKSQSGDKAQQIEDAADKLAVLIGQEILKHIPGKISTEVDARLSFDTDAMVQKGRKLIKLYADAGISKDRVLIKLASTWEGIKAGEILEKEGINCNLTLLFSFAQARACAEAGVFLISPFVGRILDWYKAKTGENYTSETDPGVLSVRKIYAYYKEHGYKTVVMGASFRNTGEITALAGCDRLTVSPNLLERAEGYRRYLPRVLVDNGATKQRPALLTEKEFRFDQNEDAMATEKLAEGIRGFVVDQNKLEKALAEKL

SEQ ID NO: 9773 - protein, 798 aa, Bacillus subtilis subsp. subtilis str. 168
MFSSKERFADLFLKRLEMTCGKSFKDSAKLDQYKTLGNMVREYISADWIETNEKSRSNSGKQTYYLSIEFLLGQLLEQNLMNLGVRDVVEAGLKEIGINLEEILQIENDAGLGNGGLGRLAACFLDSLASLNLPGHGMGIRYKHGLFEQKIVDGHQVELPEQWLKNGNVWEVRNADQAVDVPFWGEVHMTEKSGRLHFRHEQATIVTAVPYDIPIIGYETGTVNTLRLWNAEPYAHYHGGNILSYKRETEAVSEFLYPDDTHDEGKILRLKQQYFLVCASLKSIVNNYRKTHKSLSGLHKKVSIHINDTHPALAVPELMRILLDEENMSWEEAWHITVHTISYTNHTTLSEALEKWPIHLFKPLLPRMYMIIEEINERFCRAVWEKYPGDWKRIENMAITAHGVVKMAHLAIVGSYSVNGVAKIHSDILKEREMRDFHLLFPNRFNNKTNGIAHRRWLLKANPGLSAIITEAIGDEWVKQPESLIRLEPYATDPAFIEQFQNNKSKKKQELADLIFCTAGVVVNPESIFDVQVKRLHAYKRQLLNVLHIMYLYNRLKEDSGFSIYPQTFIFGAKASPSYYYAKKIIKLIHSVAEKVNYDPAVKQLIKVVFLENYRVSMAERIFPASDVSEQISTASKEASGTGNMKFMMNGALTIGTHDGANIEILERVGPDCIYTFGLKADEVLSYQENGGYRSREYYQHDRRIRQVADQLINGFFEGEADEFESIFDSLLPHNDEYFVLKDFSSYADAQERIQADYRERRKWSEHSIVNIAHSGYFSSDRTIREYAKDIWGIKPMM

SEQ ID NO: 9774 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPGKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 9775 - protein, 185 aa, Pseudomonas aeruginosa PAO1
MSHLATSTFQPLNIAILTVSDTRTLETDTSGQTLADALLAAGHRLHQRSLKTDDIYQIRAVVSAWIADPEVQVGLITGGTGFTARDNTPQAVGPLFERDVEGFGELFRQVSQREIGTSTIQSRALAGLSNGTLVCCLPGSPGACRTAWNEILLAQLDSRTRPCNFVPHLKTPPAVAPVAGCGCRS

SEQ ID NO: 9776 - protein, 557 aa, Schizosaccharomyces pombe
MAIPILDALTSSSGKKNSAEFSIHSTSNPTNPEEPNITSEADNAEDLAALGYKQEFQRGLSLFSVFSVSFSLLGLLPSVATTLPYSIGYTGTPGLLWGWLIAMVFIICIALSMAELCSAMPTSGGLYYAAAVLAPEGWGPLAAWFTGWSNYIAQLVGGPSINYSTAAMLLGAVNIGNPNYEVQNYQLFLVSIAIQFIHFILASMPTKYIAKLNSVGTYLNTLFLFISMIVILAMSSKNHGFNETSKVWSHIENYTDWPDGFAILMSFCGVIWTMSGYDAPFHMSEETANASVNAPRGIILTAAIGGIMGWVMQIVIAYTVVDQTAVVTGSDSMWATYLSQCLPKRAALGILSLTIVSSFLMGQSNLIASSRIAYSYARDGVLPYSEWVATVNPITKTPIRAVFVNFVIGVLILFLAFAGAITIGAVFSVTAIAAFTAFVAPVAMRVFFVKDADFRTGPFNLGKFSKPIGFCSVSFVALMIPILCFPSVKNPTPAEMNWTCLVFGAPMLAVLIWYAISGRKWFKGPRINLASEGDNSTLEGVELYTGSEELPQKKEKE

SEQ ID NO: 9777 - protein, 203 aa, Triticum aestivum
GFAVVGLPARGEIYVIGGVEEGGDKAVSSVAVYSAATNGWGQVAGMRTPRGYMAAGEVGGRVVVAGEDGEAEVFDPESARWAPAAARGGAAVARYDAAAAGGKLYVTEGWAWPFERAPRGAVYDAAADAWSDMARGMREGWTGSCAVSGGRMYIVAEYGEWRLKRYDEPRDEWRMVAGGGVPQEVRRPHVVAGQLEEVGGGRR

SEQ ID NO: 9778 - protein, 196 aa, Brassica napus
MGRKKLEIKRIEKNSSRQVTFCKRRNGLIEKARQLSVLCEASVGLLVVSASDKLYSFSSGDRLEKILDRYGKKHADDLNALDLQSKSLNYSSHHELLELVESKLVESIDDVSVDSLVELEDHLETALSVTRARKAELMLKLVESLKEKENLLKEENQVLASQIEKKNLEGAEADNIEMSSGQISDINLPVTLPLLN

SEQ ID NO: 9779 - protein, 353 aa, GIBBERELLA ZEAE PH-1
MGCGMSTEEKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 9780 - protein, 404 aa, Leptospira interrogans serovar lai str. 56601
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITSEQLKKVITPKTKCLILNSPSNPTGAGYSKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGFSETSLSKIFCSTLLEKYKVAAVPGIAFGEDQALRLSYAMGENDIRRGVERIAEMIRDLN

SEQ ID NO: 9781 - protein, 302 aa, Oryza sativa
  unsure (1)..(302): unsure at all Xaa locations
MKWNLRGRPRSPHSALRGCALPPRVYLYAPSYHSSQSDSRRKKKKQQQQSSQPVRRARSNRGSKRRRREDSTVRLYRLMGEEDISNDSKSSCGCEXDARVEAPAXAAAPKENGRAADPRLQAISDAIRVVPRFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCACLHLFILIAPTICILERAGADVVECACLIGLPKYKNFYKLNGKPVYILVESRK

SEQ ID NO: 9782 - protein, 474 aa, Ceramium brevizonatum
RCESGVIPYAKMGYWDPDYVVKDTDILELFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKRHYMNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLEGYLKVDLPKGIFFEQDWASLRKVTPVASGGIHCGQMHQLLDYLGNDVVLQFGGGTIGHPDGIQAGATANRVALEAMVIARNEDRDYVTEGPQILRDAAKTCGPLQTALDLWKDITFNYTSTDTADFVETPTANV

SEQ ID NO: 9783 - protein, 187 aa, Eremothecium gossypii
MSINEYAKELKAALAQYPNFPKEGVLFEDFLPIFRSPQLFQKLIDAFKMHLAEAFPETKIDYLVGLESRGFLFGPSLALAIGAGFVPVRKAGKLPGQVVKTTYVKEYEEDVFEMQVDSIPVGATVVVVDDILATGGSAGAAGDLIKQLGATILEFIFVMELDFLKGREKLQAPVFTLLQGQEEALGN

SEQ ID NO: 9784 - protein, 831 aa, Streptomyces avermitilis MA-4680
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 9785 - protein, 444 aa, Rhizobium sp. NGR234
MTTPQDFRIEAIGRDATSEIQSAINTVSASGGGRVSLLAGEHMAGGLLLKSGVELHLADGALLRPIPDYEAYRDTTVRVIAEKSNRGMIIARNAEDVRISGPGRIEAGGEHFITGDDPDVGTFIPAEFRPRVVVFEGCRTVRLDGFQVAGSPMWTLHLADCEDVVIRNVTIANDRRLPNTDGMVLDACRRVLIEDCTISTADDGICLKTSAGPDGKAIGVCEDVTVRRCNVSSLSCALKLGTESHGDFDNVVFEDCKVSTSNRGLGLFSRDGGQMRNIRFSRIEVDCHETPDGFWGSGEALTVTVVDRRPNRPAGAVENLLVEAITGRTQGAINLVSTSGAGIRNVALRGITLAQDHGPLGTGRRYDLRPTFADIAPSAEAAGRANAWTRDADGQIVGLIDYPGGMPAIYLKGVEGLTAQDVAVRRPAPLPEGWNAKDIVEETN

SEQ ID NO: 9786 - protein, 263 aa, Menegazzia terebrata
PFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYSATQKTVDGPSAKDWRGGRTAAQNIIPSSTGAAKAVGKVIPSLNGKLTGMSMRVPTSNVSVVDLTCRLEKSVTYDQIKETMKKASEGELKGIMAYSEDALVSTDLNGDNHSCIFDAT

SEQ ID NO: 9787 - protein, 516 aa, Oryza sativa
MAAGDQAADDPDSLRLLQLGYKQELKRGLSTLSNFAFSFANISVLTGVTATYNTGLRYGGPVSMTLGWLVVALFNGCVALSMAEICSAYPTSGGLYYWSAKLAGKEWASLASWVTGWYQLLWQWAAIASVDFSLAQLLQVIILLSTGGANGGGYMASKYVVLVICAVILILHGVINSLPIQWLSLFGQIGAIWNAAGVFVLVILIPAVAKDRPSVEFVFTHLNTDNGMGIHSKAYILAVGLLMSQYSVLGYDTSAHMVEETKNADRSGPIGIITSVVCATVFGWIYLLALTTAVTDIPYLLSPGNDAGGYAIAQALYTAFHRRFGSGAGGIACLGAVAVAIFLCGIACVTSNSRMAYAFSRDGAMPLSRVWYRVNKHEVPLNVVWLAVAVAFFMALTSLGSQVAFQALGSIATLGMYIAYALPVFFRVTTARRSFVPGPFNLGKYGVLVGWVGVVWVATVTVLFSLPVAYPVANKETFNYTPVAVGGVLLLSVGAWVLHARFWFQGPITNTSDGPI

SEQ ID NO: 9788 - protein, 81 aa, Brassica oleracea
QVEESTSHMQQSQHNFHLSGCSTEAHYNYISVVPESTSSDTTVQHAKEAIDQASGPPTQMVQQLNPADREARVLRYREKKK

SEQ ID NO: 9789 - protein, 482 aa, Novosphingobium aromaticivorans
MSFPGGFAMRERLQQYIDGKWVDSEGGKRHEVINPTTEEPCCVITLGTQADVDKAVAAAQRAFKTFSKTTREERLALLERIVEEYKKRVPDLAAAMAEEMGAPVSFASTAQVGAGIGAFLGTMAALRNFSFVEDNGAFKVAYEPIGVVGMITPWNWPLNQIALKVAPALAAGNTMILKPSEECPTNAAIFTEILDAAGVPPGVFNLIQGDGPGVGTAISSHPGIDMVSFTGSTRAGILVAKAAADTVKRVHQELGGKSPNVVLPDADFAKYLPSTASGPLVNSGQSCISPTRILVPREREAEAAAFVSAMYSATPVGDPMQEGAHIGPVVNKAQFDKIRGLIQSAIDEGAKLETGGPDLPANVNRGYYIKPTVFSGVTPDMRIAQEEIFGPVATIMAYDSLEEAIEIANDTAYGLSACITGDPAKAAEVAPELRAGMVAINNWGPTPGAPFGGYKQSGNGREGGLYGLKDFMEMKAISGLPA

SEQ ID NO: 9790 - protein, 173 aa, Glycine max
AYVSSEAGARFYGKRCRRGLSSHFDGKSKSFSDLSQMSNLSNLKELQKQESPFNKRRRVLIASKWSRRSSFYSWSNPQSMPLLPVDEDQDYDYEEEEEEEDDEEKARKVPSASSSSSSSLAEEKKQEDQVQLRLNRVPESYAAHMRLRLGSFKARSFSLADLQEHDDEEEDDD

SEQ ID NO: 9791 - protein, 208 aa, Oryza sativa (japonica cultivar-group)
MGEYCDWRRSEAIKRQDREATNPSAIRGRRRRRRRRRRGDREMESAMFGLETPLMTALQHLLDIPDGEGGAAGKQGATGGPTRAYVRDARAMAATPADVKDLPGAYAFVVDMPGLKSSDIKVQVEEERLLVISGERRRGGGEEEKEESCKYLRMERRMGKFMRKFVLPDNADVDKISAVCQDGVLTVTVEKLPPPEPKKPKTIEVKVA

SEQ ID NO: 9792 - protein, 660 aa, Glycine max
MKNRRLSVNPLVVGKTRAKQYYANDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKKLLESGELTQEEIDRIHKKVTSILNEEFLASKEYIPKRRDWLSAYWLGFKSPEQLSRIRNTGVKPEILKNVGKAITTIPENFTPHRAVKRIYEQRAQMIETGEDIDWGFAEALAYATLLIEGNHVRLSGQDVERGTFSHRHAVVHDQTTGEKYCPLDNVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHREFRKPLIVMSPKNLLRSKACRSNLSEFDDVQGHPGFDKQGTRFKRLIKDQNEHKDVEEGIRRLVLCSGKVYYELDEHRTKVDAKDVAICRVEQLCPFPYDLVQRELKRYPNAEVVWCQEEPMNMGGYTYILPRLISSMKAVNRGGYDDVKYVGRAPSAATATGFLKVHQKEQTEIAEKALQQEPIDFPF

SEQ ID NO: 9793 - protein, 245 aa, Shigella dysenteriae
LLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGDLSEYSFIQTKEPLDREGKVSRIVEFIEKPDQPQTLESDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 9794 - protein, 121 aa, Buchnera aphidicola
LLCSNLFGDIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 9795 - protein, 410 aa, Oryza sativa
PPPPPRAPNPKTLAPPAAARRRRRRWLTRRTPPRPPRRGSPARLRRLGRRPSVRPPRASPTVARRRRRGSASRSATSRPSPTPSSSPPASRTTPSSSSRRPSSPSPPRRRRRPAAAAAAPPCHPRRRRRRRPPPGWDPQYASDIYTYLRSMEVEARRQSAADYIEAVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 9796 - protein, 426 aa, Clostridium cellulolyticum
MIRKEMIAMLLAGGQGSRLGVLTKNVAKPAVLYGGKYRIIDFSLSNCTNSGIDTVGVLTQYQPLKLNAHIGIGKPWDMDRIEGGVTILSPYLKAEMGEWFKGTANAVYQNIQYIDKYSPHYVIILSGDHIYKMDYSKMLDFHKENHADATISVINVPYEEASRYGIMNCHENGKIYEFEEKPKNPKSTLASMGVYIFTWSTLREYLIKDNECSDSVNDFGKNIIPAMLGDGKSMWAYQYSGYWRDVGTIQAFWESSMDLVSRVPQFNLFDPEWRIYTPNPVKPAHYIASSACVKKSIIAEGCSVHGTVINSILFPGAYIEEGAVIQDSIIMSNSRVCKNAYINRSIISEQAIIGEKARLGEGPDVPNEYKPGIYDSGITVVGEKSSIPADPVIGKNVMIDIGASAVDFTSLNVQSGKSVFKGGVAE

SEQ ID NO: 9797 - protein, 381 aa, Zea mays
MRRVALLLVAAVCALAAPAAAVVTDGLLPNGNFEDGPPKSALVNGTVVSGAHAIPRWETSGFVEYIESGHKQGDMLLVVPQGAHAVRLGNEASIRQRLAVARGAYYAITFSAARTCAQAERQRLNVSVSPEWGVLPMQTIYGSNGWDSYAWAFKAKMDAVTLVIHNPGVEEDPACGPLIDGVAIRALYPPALARRAGGNNLLKNGGFEEGPYFLPGASWGVLVPPNIEDDLSPLPAWMIVSSKAVKYVDAAHFAVPQGARAVELVGGRESALVQEVRTVPGWTYRLAFAVGDSGDGCAGSMAAEAYAARATVKVPYQSRGTGGYKRAVLDFTAIANRTRVVFQSTFYHMKPDGTLCGPLVDDASLVGLRKKKPARRLMQLL

SEQ ID NO: 9798 - protein, 242 aa, Mycoplasma hyopneumoniae
MKKIIIGNWKMNKTVSETRDFIQKFDIFYQENVGKIKEDLDFAIAPSFISLSLISKSLTKKLEIAAQNLSQFDSGAFTGEISGKMLQDLGTKYVIIGHSERREIFKEKDEELKNKILQAQKYDLIPVFCVGESLLEFEAGLTKKVIISQINAIKSVLNFQKAIIAYEPIWAIGTGKTATAAIAEKVCGLIKENFGKNTMVIYGGSVNSKNINELVSQKSIDGALVGGASLDPEEFGKILVNS

SEQ ID NO: 9799 - protein, 486 aa, Triticum aestivum
MRWKLGTAAYKRVPSRDAAMDPDLETPEKTPDGGGGGAGAGPSWRRSLPHVCVATVTSFLFGYHTGVVNEPLESISADLGFAGNTLAEGLVVSICLGGAFVGCLFSGSVADGIGRRRAFQLSTLPMIVGAALSALTNSLEGMLFGRLLVGAGMGLGPPVASLYITEVSPPSVRGMYGSFVQIATCLGILFSLLVGTPVKDIDRWWRVCFWVSAVPAVLQAIAMEFCVESPQWLYKCGRTNEAEMQFEKLLGPLHVKSAMAELSRSERGDDGESVKFSELFYGRHFNVVFIGTTLFALQQLSGINSVFYFSSTVFRSVGVPSSLANICMGIANLLGSIIAMLLMDKLGRKMLLVGSFFFMAFSMGLQAIGANRHLGSASVYLSVGGILLFVLAFSLGAGPVPGLLLPEIFPNKIRAKAMALCMSVHWGVNFFVSLLFLRLLEQLGPQVLYTMFSSACVVGAIFVRRHVVETKGKTLQEIEVSLLQTQ

SEQ ID NO: 9800 - protein, 242 aa, Mangifera indica
RLQLQKKGVGGDGLVLPKYKGLLGTVGTIAREEGLAALWKGIVPGLHRQCLFGGLRIGLYEPVKTFYVGSDFVGDVPLSKKILAAFTTGAIGITIANPTDLVKVRLQAEGKLPPGVPRRYSGALNAYSTIVRQEGLGALWTGLGPNVARNAIINAAELASYDQVKQTILKIPGFTDNVVTHLLSGLGAGFFAVCIGSPVDVVKSRMMGDSAYKSTLDCFIKTLKNDGPLAFYKGFIPNFGRL

SEQ ID NO: 9801 - protein, 361 aa, Streptomyces ambofaciens
MPELPPPHVVREAEKARAELQRQSRELAPPPFALLEMIMGVMVSRAVHVVAELKVAEALAEGPLSAEELAGRVGADADALGRVLRLLASNGVFATRADGTFELTPMADALRADHPMSMRPIALLMGHPIHWEDWSGFPETVVTGEPALPKLRGMHAFEFLTKNAEYGQVFFEGMGSMSASETGPIVAAYDFTRFGTVVDFCGGQGGLLAGILASSPATRGVLYDPRVEENGAAEFLAAQGVADRTERVAGDLFEVPPGGADAYVLKHIVHDWPEEQALQILRNVRAAIKPGGRLLIAEMVIPEQGDEPHSGKLVDLWLMLLVGGRERTPGQYADLLARAGFRLERVVETAAAISLVEAVPV

SEQ ID NO: 9802 - protein, 692 aa, Zea mays
MWRLKIGEGGGPWMQTVSGFHGRQVWEYDPDAGTDEERSKVEQLRREFTENRFRRRESQDLLMRMQLTGQKHLLADMRAATKIEDGDEVTEESLQESLKRALGWMSGLQAEDGHWPGDYSGIMYIMPFWIFALHITGSIDAVLSKEHRREICRHIYNHQVIGVYDWRGNNPVVPELWLVPRFLPIHPGRFWCFTRITYMSIAFLYGKKFIGPITPTILELREELYSLPYVQIDWSKARNSCAKEDIRNKPSEIFKFISTCLNMFVEPVLNYWPLNKLRERALNHILEHIHYEDETTQYIGISPVTKALNMICCWVENPNSDALKRHIPRIHDYLWIAEDGMNTKIYDGTHNWELALIIQAMLSADAANEYGPTIQRAMEYLKRAQVTTNPPGNPSYWFRHRSKGSWPLSTIDNGWGSSDTSAEATKALLMISKVYPNLVENSNGDEWMLNAVDCLLSFMNKDGSVSTFECQRTYSWLEILNPLESFRNIVADYPTVECTSSVLQALVLFEEFNSEYRSKEIKENVKKAAIYIENNQNKDGSWYGTWGICFVYGTLYAIKGLVAAGRNYENSICIRKACNFLLSIQLKTGGWAESYHSCERQVYVEGHSTHVVQTAWAMLALIYTGQMERDPTPLHRAAKVLINMQLETGDYAQQEHVGSTNCSVYFNYPNYRILFPVWALGEYHRKVCTKSN

SEQ ID NO: 9803 - protein, 108 aa, ASPERGILLUS NIDULANS FGSC A4
MSRHHPDLVMCRKQPGISIGRLCDKCDGKCPVCDSYVRPTTLVRICDECSFGNYQNKCIVCGGEGISDAFYCFECTRLEKDRDGCPKIINLGSSRTDLFYQKKSFRNH

SEQ ID NO: 9804 - protein, 347 aa, Burkholderia fungorum
MLRERGVRFLMNTTVDGLRRSPHGVEAFSGGAALPADHVVLASGAGAARLLKPIGIRAAIYPIKGYSLTFELQAQSTAPHVSITDSGRKVVYARLELLARNDVDGVVVTHGTDTIEETSYFLHLTLKSAKPVVVVGSMRPPSAMSSDAALNLYDALAVAAHPSSRGLGALVVANSEIHTARDVVKSNSFKLDAFRSPYGALGIVIEGTPRYYRRPARAHTLDTPWSIDTLRTLPKVDIVYAYGALESSAVAAIAKNARGLVFAGTGNGNVAGHLIGPLRDAARRGVRVVRASRTGNGVVLHNAAQPDDEYGWLTVDDQAPLKARLLLTLALTQTDDTNALQAVFERY

SEQ ID NO: 9805 - protein, 185 aa, Glycine max
MISFQCSDKLGLSLELGSFMAGVMISTTDFAQHTLDQVEPIRNLFAALFLSSIGMLIHVHFLWNHVDILLASVILVVVVKTAVAVLVTKAFGYSLKTSFIVGISLAQIGEFAFVLLSRASNLHLVEGKMYLLLLGTTALSLVTTPLLFKLIPAVMNLGVLMHWPPNESSTQIEGKTSVIEANRML

SEQ ID NO: 9806 - protein, 498 aa, Lycopersicon esculentum
MKKVTVGVAVVGAAAVCAVAVLIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDELFDYIAAELAKFVAAEEEKFHQPPGKQRELGFTFSFPVMQTSINSGNIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVAEEAGVFGDEVPPKLKEPFVLRTPDMSAMHHDTSSDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQDA

SEQ ID NO: 9807 - protein, 297 aa, Bacillus cereus ATCC 14579
MQVGLIGLGKMGLNLGKNLMDHKHEVVAFDLNTSAVEEMKEYGATGTSSLSELVQSLQSPRILWVMVPHAVVDSVIDEVTPLLSKGDILIEAGNSHYKESIRRYEQLKEDGIHFMDAGTSGGMEGARNGACYMIGGDQEAWDIVEPIFRDTAVENGFLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 9808 - protein, 343 aa, Zea mays
MESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWSNMYFRSFWKNAQSKGQISGDSPPDPSHFMRNGSSPGSNFTGKLDDNHNIVTSAAASGAQDQAETDHVASGCYRSAETPANITNNAISQSQPQRTGPSPVDDSAVKSEMLNSQELAIDEGMISVSSTYSQELLKSLSHALQSSGVDLSQTSISVQINLGKRAGKRSAAGVSSNSKEPPPADPASSNELGGHHLTTLGASADGLPHATKRHKRGNS

SEQ ID NO: 9809 - protein, 966 aa, Solanum tuberosum
MATANGAHLFNHYSSNSRFIHFTSRNTSSKLFLTKTSHFRRPKRCFHVNNTLSEKIHHPITEQGGESDLSSFAPDAASITSSIKYHAEFTPVFSPERFELPKAFFATAQSVRDSLLINWNATYDIYEKLNMKQAYYLSMEFLQGRALLNAIGNLELTGDFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKICYILYPGDESEEGKILRLKQQYTLCSASLQDIISRFERRSGDRIKWEEFPEKVAVQMNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHISTAGMEASGTSNMKFAMNGCIQIGTLDGANVEIREEVGEENFFLFGAQAHEIAGLRKERADGKFVPDERFEEVKEFVRSGAFGSYNYDDLIGSLEGNEGFGRADYFLVGKDFPSYIECQEKVDEAYRDQKRWTTMSILNTAGSYKFSSDRTIHEYAKDIWNIEAVEIA

SEQ ID NO: 9810 - protein, 463 aa, Triticum aestivum
  unsure (1)..(463): unsure at all Xaa locations
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNXSSMGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDFLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPGGAILDGTCIRDMITLHLFL

SEQ ID NO: 9811 - protein, 252 aa, Streptococcus mutans UA159
MSRKPIIAGNWKMNKTAAEAREFIDAVKNNIPSNNLVDTVIGSPALFLEGMKKGVKGTELQVAAQNCYWEDFGAFTGETSPAALAALGVDYVIIGHSERRDYFHETDQEINKKAHAIFKHKMTPILCCGESLETYEAGKTAEWIEGQITADLKGLSAEQVSSMVIAYEPIWAIGTGKSADANIADDICGVVRATVEKLYGKEVAQAVRIQYGGSVKPENVAEYMAKENVDGALVGGASLQADSFLALLDFVK

SEQ ID NO: 9812 - protein, 365 aa, Glycine max
  unsure (1)..(365): unsure at all Xaa locations
MATTRSAPLLKHLLTRLNPSRSVTYMPRPGDGTPRXVTLIPGDGIGPLVTGAVEQVMEAMHAPLYFEKYEVHGDMKAVPAEVLESIRKNKVCLKGGLATPMGGGVNSLNVQLRKELDLYASXLVNCFNLPGLPTRHDNVDIVVIRENTEGEYSGLEHEVVPGVVESLKVITKFCSERIAKYAFEYAYLNNRKKVTAVHKANIMKLADGLFLESCREVATRYPGIKYNEIIVDNCCMQLVSKPEQFDVMVTPNLYGNLVANTAAGIAGGTGVMPGGNVGADHAVFEQGASAGNVGNDKVVEQQKANPVALLLSSAMMLRHLQFPAFADRLETAVKKVILEGKYRTKDLGGTSTTQEVVDAVIDALD

SEQ ID NO: 9813 - protein, 69 aa, Lactobacillus gasseri
MTVYIEKVRAMEIFDSRGNPTVEVHVALSDGTIAKSEVPSGASTGEKEAVELRDGGECLDGKGRYECRK

SEQ ID NO: 9814 - protein, 168 aa, Glycine max
MIFSPSVTTVNRAGAGVVALFTGLMSMAGFPTENTNSDITYIASNCGRVQCVRVWPPFGKKKFETLFYLPDLDDAQLAREVIYLLRKGWIPCLEFELEHGFVYREHNRSPVLYYGLYWTMWKLSMCGCSDASHVLRDLLDAKSAYPCGFMRIIICHNVTQVHRISFIV

SEQ ID NO: 9815 - protein, 1514 aa, Oryza sativa
MSRSVQLAVAAGDQVDPDSLRLHQLGYKQELKRGLSALSNFAFSFANISVMMGVTTTYNTGLRYGGPVSMTLGWLVVAVFNCCVALSMAEICSAYPTSGGLYYWSAKLAGKQWASLASWVTGWFNVVGQWAAIASVDFSLAQLLQVIILLSTGGGNGGGYMASKYTVLAIYAFILILHGIINSLPIEWLSLFGHVGAIWNAAGIFVLTILIPAVAKDRPNIEFVFTHLNTENGMGIHDKAYILAVGLLMSQYSVIGYDTSAHMVEETKNADRSGPIGIITSVLFATVFGWIYLLALTSVVTDIPYLLSPSNDAGGYAIAQALYTAFHRRYGSGVGGIVCLGAVAVAVFLCGIACVTSNSRMAYAFSRDGAMPLSRVWYRVNKHEVPLNVVWLGVAVAFVMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVALFGPVFIAALFFPLVRRARRAAAIREYATAGSSPPACNGFACGGAFESSTTGGACSRRGGAPAPFACDCPAAQPCALPCPASMRALVASSALLRRSAARANLSGAGFCNGAPPVSSPLRRFPLQRFSRTRRTPVISTGSLKLDIALGIGGLPKGRMVELFGKEASGKTTLALHVVKEAQKKGGCCAYIDAENAFNPSVAEAIGVNVEKLLIAQPDSAENSLSIVNTLVGGSIDVVVVDSVRTKLSSNQTPGIFKEVACGGNALGFYAAVRMRTSRRELRYNEAQATGIGISVQIIKNKLAPATLKEAGIDIRFGKGICYESEILELASSLGVIMKDDSGYWINGEFLPNKAEAEKFLRENAAVADEICGTMRRQFFESMRSIGVCYGMNGDGLPSRSNVVQLYKSNGIGAMRIYSADREALDALRGSGIDLALDVGERNDVGQLAANADSWVQDNVKAYYPDVKIKYIVVGNELTGTGDAASILPAMQNVQAALASAGLADSIKVTTAIKMDTLAASSPPSAGVFTNPSVMEPIVRFLTGNGAPLLANVYPYFAYRDSQDIDLSYALFQPSSTTVSDPNGGGLSYTNLFDAMVDAVRAAVEKVSGGGSSVVDVVVSESGWPSDGGKGATVENARAYNQNLIDHVAQGTPKKPGQMEVYVFALFNENRKEGDATEKKFGLFNPRQDTAALLLLGVFISIPVDNEGVQSVGVCYGMIGNDLPSKSDVVQLYKSNGITDMRIYLPDVEAMNALRGTGIGLIVGVANDILIDLAANPASAASWVDANVKPFVPAVNIKYIAVGNEISGEPTQNILPVMQNINAALAAASITGVKASTAVKLDVVTNTFPPSAGVFAAPYMTAVAKLLASTGAPLLANIYPYFAYIGNKKDISLNYATFQAGTTVPDPNTGLVYTNLFDAMVDSVYAALDKAGAAGVSIVVSESGWPSAGGDSATIDIARTYVQNLIKHAKKGTPKRPGVIETYVFAMFNENQKPGEATEQNFGAFYPNKTAVYPINFQ

SEQ ID NO: 9816 - protein, 337 aa, Zea mays
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKTQ

SEQ ID NO: 9817 - protein, 76 aa, Zea mays
  unsure (1)..(76): unsure at all Xaa locations
APRPGRTXXRTRTAGPKHGEKXEGRGGNNGXTRTAGGRANREGXTGGGXDKXQQANHXXPXTQARTSRDGSHNGEE

SEQ ID NO: 9818 - protein, 511 aa, Torenia hybrida
MTVATTLVVVLSRELLLYVLVVYILVSKSLSTIIVVSRKRLPPGPTGFPVVGALPLLGSMPHVALAKMAKKYGPVMYLKTGTLGMVVASTPSSARAFLKTLDSNFSNRPANAGATHLAYGAQDMVFAPYGPRWRLLRRLSNLHMLGGKALDGWANVRASELGHMLEAMNRASREGEVVVVPEMLVYAMANMIGQVILSRRVFVTKGEEVNEFKDMVVELMTSAGYFNIGDFVPILAWMDLQGIERGMKALHKKFDKLITRMLEQHEASAHKPDFLDAIIAASLDDYSSEEERLSTSNIKALLLNLFTAGTDTSSSTIEWALSEMLKKGKILKRAQEEMDRVVGRERRLVESDIEKLGYLKAICKETFRKHPSTPLNLPRISSEACVVNGHYIPKGTRLSVNIWAIGRDPEVWEDPLEFNPDRFLHSKMDPRGNDFELMPFGAGRRICAGTRMGIVLVEYILATLVHSFDWKAADQDNNIMNMEEAFGIALQKATPLKALVTPRLPLHCYLP

SEQ ID NO: 9819 - protein, 233 aa, Trichodesmium erythraeum IMS101
MISVEKSIGLLETMTSYATTTARAEMSEIRRLKGLLPPELQSWVMVEKSLEVNPSLIRSEEIGKDQVEVSIDLARWEQLALDQRNLLFWHEVARIQNDTIPRDGWEMAALAIGLGGAVGELWVQDGLLLVLALALCGVSGYRLYQKNNGERNLKEAIEADDKAIVLATRFGYSLPNAYKSLGSALKTLIEETPKKRQRAKYEARLQAIKRSAAKAKARVKGSRETSRSENIYN

SEQ ID NO: 9820 - protein, 221 aa, Triticum aestivum
QKCKVVDLGIAKDTEESLMEHMDAALHSDADIILTSGGVSMGDRDLVKPCLAKMGKIHFEKIRMKPGKPLTFAEITSNDPTKPSKTALAFGLPGNPVSCMVCFNLFVVPAIRLVSGWSNPHLERVHVRISHPLRADPHRMEFHRAVIRWVLDDGSGRPGYVAESTGQQASSRLLSMKSANALLEVQSSDQILAVGALCQAILICDITSPPRNKRCGVYSPL

SEQ ID NO: 9821 - protein, 354 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAVPPRHCPPPPRPSSSTSSVSVH

SEQ ID NO: 9822 - protein, 225 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGADILVRLAIFGASDRAKAIASIRGAAESGLGQEAA

SEQ ID NO: 9823 - protein, 237 aa, Populus tremuloides
SGTENKINRQVTFAKRRNGLLKKAYELSVLCDAEVALIIFSNRGKLYEFCSTSNMLKTLERYQKCSYGAEEVNKPAKELENSYREYLKVKARFEALQRTQRNLLGEDLGPLNTKDLEQLERQLESSLNQVRSTKTQYMLDQLADLQNKEHLLLEANRGLTIKLDEISARNSLRPSWEGDDQQNMSYGHQHAQSQGLFQALECNPTLQIGYNAVGSDQVSAITHATQQVHGFIPGWML

SEQ ID NO: 9824 - protein, 254 aa, Zea mays
FGTRETFAQFGVVFLLFALGLEFSLTKLKVVGPVAVLGGLLQIVLFMFLCGLTAALCGAKSSEGVFVGAFLSMAPSAVVSNFLVEKGSTNTLHGQVTIGTLILQDCAVGLLFALLPVLGGASGIFGGVMSMAKLLLVLSIFVAVTYMMTWSIVPRFLKLMIQLSSQTNELYQLASVAFCLLLAWGSDYCGLSLELGSFLAGVMISTTDFAHHTMEQVEAIRNLFAALFLASIGMLIHVKSWWNHVDILLAAVIL

SEQ ID NO: 9825 - protein, 196 aa, Mitthyridium sp. Wall 3826
GGAKKVVISAPSKDAPMFVMGVNEEKYTNEDIVSNASCTTNCLAPLTKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIALSDTFVKL

SEQ ID NO: 9826 - protein, 220 aa, Ceratopteris richardii
MGRGKIEMKRIENRTTRQVTFCKRRAGLVKKARELSVLCDADVALIVFSSSGRLFEYAGSRSMREIIQAYVDAHEDSSSLLQLRSEEACVSQDLRAELTELRKEVESLRQEKRRKDGDIHDLKLLSADELDSLEGEVETSLCSIRKRQKQLYREKMNETFRKEEELRKENEKLRKQVEELQCARWEICCAQGFEASATSMCTSHGMTSERSDSFLDLRLN

SEQ ID NO: 9827 - protein, 507 aa, Candida albicans
MRSYKSSITDENELTKQRLRAKSIANLSSNHATAGQTSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNDDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSRVDLKTSFQQCGTLHFIQSSQNH

SEQ ID NO: 9828 - protein, 306 aa, Zea mays
  unsure (1)..(306): unsure at all Xaa locations
MASDGSGVVTVYGSNGAELLEPSKQPKSATFSVKVGLAQMLRGGVIMDVVTPEQARLAEEAGACAVMALERVPADIRAQGGVARMSDPXGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLXATPADAALMMQLGCDGVFVGSGIFKSGDPARRARAIVQAVTHYSDPTILADVSTGLGEAMVGINLNDPKVERYAARSE

SEQ ID NO: 9829 - protein, 559 aa, Prochlorococcus marinus subsp. marinus str. CCMP1375
MINCKSVLQIIKRYFRALRIWRSVFTLLSYLWFDSQDWSYIGGFTIEKQKSRQKARAQWLTKELLHLGSAFIKLGQLISARPDVLPRDWVTELAGLQDKVPPFSFEDAQEIVEKELGARCKEIVDLEEIPIAAASIAQVHRACLSSGRKIVLKIQRPGLEAFFRLDLEVMQKVAALLQRNKSFSKGKDWISIAKECKRVLLKELDFRIEAQYAARFRQQFLDEPNIKIPGVIWELSTQKVLCLDYLPGIKINDQAAIIKSGVNPSKIAELGASSYLKQLIEYGFFHADPHPGNLAVSSDGSLIFYDFGMMGMISDRLRNKLGSMVRAAALQDATKLIQALQEAGLLAQEIDLGPVRRLVRIMLKERLTPPFDKDVIEKLSVDLYELVYGQPFRLPVELIFVMRALSTFEGVGRSLDPSFNLIAITKPYLITIMNSNNSNPNDLINEIGRQFGELGTKAVGLPKRLDENLERLEQGDLQLQIRLGESDRQLRRMISAQQSMSQSILLGCLGISAALLGSSNKSFFSIIPIVIALPISINWLKIQIKIRRDENIERIKGNK

SEQ ID NO: 9830 - protein, 393 aa, Solanum commersonii
MALNFNSPTFQSIKTTRRPCSPLRSPRVFMASTLRPPSVEDGNVKKPFSPPREVHVQVTHSMPPEKREIFDSLHGWADNNILGHLKPVEKCWQASDFLPDPASEGFEDQVKELRERCKEIPDDYFVVLVGDMITEEALPTYQTMLNTLDGVRDETGASLTPWAIWTRAWTAEENRHGDLLNKYLYLSGRVDMRQIEKTIQYLIGSGMDPRTENNPHLGFIYTSFQERATFISHGNTARHAKEHGDMKLAQVCGIIAADEKRHETAYTKIVEKLFEVDPDGTVLAVADMMRKKISMPAHLMYDGRDDNLFEHFSTVAQRLGVYTAKDYADILEFLVGRWEIEKLTGLSGEGHKARDYVCGLAPRIRKLEERAQARAKQKAPVPFSWVFGKDIKL

SEQ ID NO: 9831 - protein, 417 aa, Mycobacterium tuberculosis H37Rv
MNLQLFLLLIVVVTALAFDFTNGFHDTGNAMATSIASGALAPRVAVALPAVLNLIGAFLSTAVAATIAKGLIDANLVTLELVFAGLVGGIVWNLLTWLLGIPSSSSHALIGGIVGATIAAVGLRGVIWSGVVSKVIVPAVVAALLATLVGAVGTWLVYRTTRGVAEKRTERGFRRGQIGSASLVSLAHGTNDAQKTMGVIFLALMSYGAVSTTASVPPLWVIVSCAVAMAAGTYLGGWRIIRTLGKGLVEIKPPQGMAAESSSAAVILLSAHFGYALSTTQVATGSVLGSGVGKPGAEVRWGVAGRMVVAWLVTLPLAGLVGAFTYGLVHFIGGYPGAILGFALLWLTATAIWLRSRRAPIDHTNVNADWEGNLTAGLEAGAQPLADQRPPVPAPPAPTPPPNHRAPQFGVTTRNAP

SEQ ID NO: 9832 - protein, 502 aa, Glycine max
RAASWWRSALLWRTFFTTAVVAIVLRVAIQFCATGKCGLFGEGGLIMYDVSSANITYSASGIFAVLLLGAIAGILGSIYNYLVDKVVRTYSIINGKGAFSKISLVVTIALLTSCCYYFLPWIAKCIRCPSNSTVICPSVDESGDYKSFQCPPGYYNDLASLFLNTNDDAIRNLFSPRIIKEFHITSLFIYFATIYCLGIITYGIAIPSGLFIPVILAGAAYGRLFGRLFETITELDRGLFALLGAASFLGGTMRMTVSICVILLELTNDLLLLPLVMLVLLVSKTVADSFNKGVYDQILKIKGLPYLEAHAEPYMRNLVTRDVVSGPLITFSGIEKVANILQALNTTGHNGFPVIDEPPFSDSPELCGLVLRSHLLVLLKEKIFSRDRGFANQRIFQRISTLDFGKAGSGKGIKLEDLDIQEEEMDMYVDLHPITNASPYTVVETMSLAKAAILFRQHGLRHMCVVPKSQGRPPVVGILTRHDFMPEHVLGLHPDIMPHKWK

SEQ ID NO: 9833 - protein, 898 aa, Oryza sativa
MPPSRSLACLLLPPLLLLLESVRDADAGPLAVEIVRPSFTATSYDYVDTGGAFLVSRNGSFRAAVFNPGKQQASFYLAVLHAPSGTPVWSANRDAPTSSTGKVQLSVGGITVSDANGTVLWSTPPLRSPVAALRLQDTGDLQLLDAGNATLWRSFDNATDTLLPGQQLLAGAYLSSAKGATDFSQGDYRFGVITADVLLTWQGSTYWRLSNDARGFKDTNAAVASMSVNASGLFAVAADGAMVFRVGLAPAEFRMLKLGSDGRLRIISYALVNSSAPVGGDFIAPAGDCDLPLQCPSLGYCSPAGNGSTCTCPPLFAASVTVAGSCTPGDGSTLASPAACQNNDSSSGGASVSYIALKPLTSYFATKFDAPTNTGVNKTACRALCTASCACLGFFHDSVSLSCRLIGGKQLGSLYKGASDTNLGYIKTFNSATKAGSNQIGSSSANHTVPIVLPSVAAFLLLAVLGWYIWWRNKMSKNGRKKKGKSSTMKVYLGRQKSPSRDTGYNADADDDGGGDDDDIVIPGMPARFSYQEITTMTSNFATKVGSGGFGTVYKGELPGGEGLIAVKKLEAAGVQAKREFCTEITIIGNIRHVNLVRLRGFCAEGSRRLLVYEYMNRGSLDRSLFGRTGPVLEWGERMEVAIGAARGLAYLHTGCEQKIVHCDVKPENILLANGGQVKISDFGLAKLMSREQSALFTTMRGTRGYLAPEWISNAAISDRADVYSFGMVLLELIHGRKNRGEQEAAAPANNVAVAAGSGEHSDLPSGWSSAMTSTASGTSGGGDEYFPMLALELHEQRRYLDLVDARLEGRVDEAEAARTVRVALCCLHEDPALRPSMATVVRILEGSVPPPEPRVEALGFLRLYGRSYPLPVPGSLTAMAGGGSHLDESLKDTSAPR

SEQ ID NO: 9834 - protein, 582 aa, Oryza sativa
MAPRIRVLAALDQARTQYYHFKAIVIAGMGLFTDSYDLFCISPVMKIFGRVYYAPSGSVDGSGSGPGVTPPAVVSATVGVALLGAVAGNVVFGALGDRVGRRRVYGACLLLMVCSSVGSGLSVCRTRRCALASLCFFRFLLGVGVGGDYPLSATIMSEFANRRTRGAFIAAVFSMQGFGILVSSAVTMAVAAAFDHYTGYPAPLDTPECADLAWRIILMAGAVPAALTYYWRMSMPETARYTALVERDVVKATNDIGRVLADLDLAAVAEEEVAAAALSPPPVTTPPPPRPSYGLFSRRFVRQHGRDLFACAAAWFLLDIPYYSSTLFQSQIYRPWFPPAAKVNAFQEAFNVAKFQAVIAVASTIPGYFAAMLLIERAGRRRLQMAGFLLMAVFLFALAGPYDGYWRDHAKTAGYIVLYSLTFFSANLGPNTTTFILPAELFPARFRSTCHGLSGAAGKLGALVGSIGFLWASQQKDGAAAGHLPGIGMMYALFVLGGICLLGLALTYAFTPETMTRSLEENESSVQAQSQVGDGGSDAGNGSDGLRFHELNVLMEAATKSPVSMASSHLSMSPILPHRMSL

SEQ ID NO: 9835 - protein, 544 aa, Oryza sativa
MGLDLGALVLKSGGLLVSDYDSIVAINIFVALLCSCIVIGHLLEGNRWVNESITALVMGLITGGVILLVSGGKNSHILVFSEDLFFIYLLPPIIFNAGFQVKKKQFFRNFMTIILFGAVGTLISFVIISLGAMTLFKKLDVGPLQLGDYLAIGAIFSATDSVCTLQVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 9836 - protein, 924 aa, Pisum sativum
MMELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 9837 - protein, 126 aa, Buchnera aphidicola (Uroleucon rurale)
NQFDILLCSNLFGDIISDECAVITGSIGMLPSASFNEKNFGLYEPAGGSAPDIAGKNIANPIAQILSLSMLVRYGMKLKKIADKIDKSVASALKAGYRTADISNNNSYLKTNEMGDVISDFLINGK

SEQ ID NO: 9838 - protein, 303 aa, Zea mays
MAFASSLLPVPPYRVCATPASEVAAFSPAKKSVSLAAARQRRGSRHGVRAEVNESGSVLAVDALSQVKHVLLPVLDRNPYLSEGTRQAAATTASLAKKYGADITVVVIDDKPKESVPEHDTQMSSIRWHLSEGGFSEFRLMERLGEGQKPTAIIGEVADEWDLDLVVLSMEAIHSKHVDGNLLAEFFDWVQIGRLHCLLPWWEDATVDFMIRGGYNVINQIKQVKHKCLILWGEDDGIISSKLAYRLHQELPDAILRQVRQCGHIPHVEKPREAAKHVLEFLARNTSNKSDQSPSEPSVVVNR

SEQ ID NO: 9839 - protein, 460 aa, Paraglossum fuegiensis
WDPDYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARKNDMILHLHRAGNSTYSRQKIHGMNFRVICKWMRMAGVDHIHAGTVVGKLEGDPLMIRGFYNTLLLPYLEVNLLQGIFFEQDWASLRKVTPVASGGIHCGQMHQLLDYLGDDVVLQFGGGTIGHPDGIQAGATANRVALESMVIARNEGRDYVPEGPQILRDAAKTCGPLQTALDLWKDITFNYTSTDTPDFVETPTANV

SEQ ID NO: 9840 - protein, 342 aa, Arabidopsis thaliana
MSLIENSCLEPESKTATLICGHFFVRYGICCNCRSTVDRDYGRAFDYLVHGLQLSHKAVAVTKSLTTQLACLNERKLHLVLDLDHTLLHSIMISRLSEGEKYLLGESDFREDLWTLDREMLIKLRPFVHEFLKEANEIFSMYVYTMGNRDYAQAVLKWIDPKKVYFGDRVITRDESGFSKTLDLVLADECGVVIVDDTRHVWPDHERNLLQITKYSYFRDYSHDKESKSYAEEKRDESRNQGSLANVLKVLKDVHQEFFRGGIEELDSKDVRLLLQEQHIAVSIKICSQNLSHQKQMSPFISGSNKHENVKFYKSQSMELDTITGTGSRVYSSSEEHCLVCT

SEQ ID NO: 9841 - protein, 313 aa, Thermoanaerobacter tengcongensis
MERIKSYYPYLAGIGMASIFGFSFMFTAMGLEVASPLELISYRFLLASIVITLLWAFGVIKLNYRGKDVKPLLLLSLAEPFIYFVFETYGIKYTSSSLSGLMIALIPVAVTILAVIFLNERPSLYQLLFILLSVAGVIFIIFMTGSEGGKSSLLGFLFLLGAVLSAAFYTILARKFSSVFSPIEITFVMMWFGAISFNILNLIEKVIRGDSLSSYFSSVANYKVLIPVLYLGILSSIVAYFLNNYALSKLPASQASVFANLTTVISIIAGVTIRHEVFYWYHVVGAIMILIGVWGTNYFGKAYEVKALSEEIH

SEQ ID NO: 9842 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTDVVEAKAGGGSATLSMGQAAARFGLSLVRALQGEQGVVECAYVEGDGQYARFFSQPLLLGKNGVEERKSIGTLSA

SEQ ID NO: 9843 - protein, 196 aa, Azospirillum brasilense
MLLLIDNYDSFTYNLVHYLGELGAELDVRRNDSLTVEEAMALRPEGIVLSPGPCDPDKAGICLPLIDAAAKAAVPLMGVCLGHQAIGQPFGGTVVRAPVPMHGKVDRMFHQGRGVLKDLPSPFRATRYHSLIVERATLPACLEVTGETEDGLIMALSHRELPIHGVQFHPESIESEHGHKILENFLNTTRRLETAA

SEQ ID NO: 9844 - protein, 496 aa, Corynebacterium glutamicum ATCC 13032
MVKYPQSTLGDLVTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 9845 - protein, 445 aa, Zea mays
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAASGRSVQKNRRKKPACTLSTVLSARSKAACPVTEKPKEPIEDIDKFDGDNQLALVDYVEDIYTFYRPPMHESRPIDYMGQTSPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGPQRAADTGRAKTLVGSHAASASPDARLKAVYQKYATEQFGRVALHPPAPAALPDLV

SEQ ID NO: 9846 - protein, 360 aa, Pseudomonas fluorescens PfO-1
MSKQILILPGDGIGPEIMAEAVKVLELANEKYSLGFELSHDVIGGAAIDKHGVPLADETLDRARAADAVLLGAVGGPKWDTIERDIRPERGLLKIRAQLGLFGNLRPAILYPQLADASSLKPEIAAGLDILIVRELTGGIYFGAPRGTRTLENGERQSYDTLPYSESEIRRIARVGFDMARVRGKKLCSVDKANVLASSQLWREVVEQVAKDYPDVELSHMYVDNAAMQLVRAPKQFDVIVTDNMFGDILSDEASMLTGSIGMLPSASLDANNKGMYEPCHGSAPDIAGKGIANPLATILSVSMMLRYSFNLHEAADAIEKAVSVVLDQGLRTGDIFSTGCTKVGTQEMGDAVVAALRNL

SEQ ID NO: 9847 - protein, 250 aa, Glycine max
MSRRYDSRTTIFSPEGRLYQVEYAMEAIGNAGTAIGILSKDGVVLVGEKKVTSKLLQTSTSTEKMYKIDDHVACAVAGIMSDANILINTARVQAQRYAYAYQEPMPVEQLVQSLCDTKQGYTQFGGLRPFGVSFLFAGWDKNFGFQLYTSDPSGNYGGWKAAAIGANNQAAQSILKQDYKDDITREEAVQLALKVLSKTMDSTSLTSEKLELAEVFLSPAGKVKYQVCSPENLTKLLVKFGVTQPAADTA

SEQ ID NO: 9848 - protein, 572 aa, Escherichia coli O157:H7 EDL933
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATTHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIIVFNNSVLGFVAMEMKAGGYLTDGTELHDTNFARIAEACGITGIRVEKASEIDEALQRAFSIDGPVLVDVVVAKEELAIPPQIKLEQAKGFSLYMLRAIISGRGDEVIELAKTNWLR

SEQ ID NO: 9849 - protein, 516 aa, Corynebacterium glutamicum ATCC 13032
MSEKSAADQIVDRGMRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 9850 - protein, 195 aa, Burkholderia multivorans
MLLMIDNYDSFTYNLVQYFGELGEDVRTYRNDEITLDDIARLDPDAICLSPGPSNPQHAGITLDVLREFAGKKPILGVCLGHQAIGEAFGGRVVRAKTIMHGKVSRIETDGRGVFADLPKHFDVTRYHSLAIERESLPDCLEISATTDDGEIMGVRHKTLPIEGVQFHPESILSEHGHALLENFLKQARAAAHAA

SEQ ID NO: 9851 - protein, 823 aa, Oryza sativa
  unsure (1)..(823): unsure at all Xaa locations
MGMVLGKITVETPKHEVLHTGAGYEVRKYPPCVVAEVTYDPAEMKGDRDGGFTVLGNYIGALGNPQNTKPEKIDMTAPVITSGEPESIAMTAPVITSGEPEPVAMTAPVITAEERSQGKGQMTMQFLLPSKYSKVEEAPRPTDERVVLRQVGERKYGVVRFSGLTGDKVVKEKAEWLKAALEKDGFTVKGPFVLARYNPPFTLPPLRTNEAGRRDRIWPILVSGAAPFRFNVGPTKRSDPYPQGCNPVYGFGRNPTSLTVAKPFNANWIESNTFVFYQASHRRREPAMAMAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPXLVCCFGAPRWEFVPTVRVSDRQMHPDIYSTWLHLQWEPPEFARAPGSAASNVGIALTRGGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQVYVPSMRREADW

SEQ ID NO: 9852 - protein, 271 aa, Glycine max
MSVSCSNCFPDDDHSFLLCGEDSSGIMDSSPECSSDLDSSPPSEAESIAGFMEDERNFVPGFEYLNRFQSRSLDASAREESVAWILKVQAYYAFQPVTAYLSVNYLDRFLNSRPLPPKTNGWPLQLLSVACLSLAAKMEESLVPSLLDLQVEGAKYVFEPRTIRRMELLVLGVLDWRLRSVTPLCFLVFFACKADSTGTFTRFLISRATEIIVSNIQEASFLAYRPSCIAAAAILTAANEIPNWSVVKPEQAESWCQGIRKVSIYSIYAWF

SEQ ID NO: 9853 - protein, 200 aa, Nicotiana tabacum
MAEVGLEGNQPVDLSKHPSGIVPTLQNIVSTVNLDCKLDLKAIALQARNAEYNPKRFAAVIMRIREPKTTALIFASGKMVCTGAKSEQSSKLAARKYARIIQKLGFDAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 9854 - protein, 178 aa, Glycine max
  unsure (1)..(178): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVXYLLKKGWIPCLKFQLXHGFMYREHNMSPXYYYGHYWTMXKLPIFGCTDTSQVLKDLQXAKTAYLNNFIHIIXFNIIHQLHIIIFITYXPSYF

SEQ ID NO: 9855 - protein, 210 aa, Glycine max
MKSFDTIMKSSDTSPQHDDYLLHKSISVDGYTYTNTDKEITAKGTGKSSNFTHRIHNHVKMGPNLSEILKGKLSLGARIIQEGGRGSIFKSVFGMQEKEQLLKASQCYLYTTAGPIAGILFVSTEKVAFYSERPITFSSATGELVRAPYKVLIPIGRIKEVNESQNVNKAEQKYIEIVTEDDSEFWFVGFLRYEKALKNLNKAISMANQF

SEQ ID NO: 9856 - protein, 284 aa, Hordeum vulgare
MARPSFSLHLCLAVLALAAAASEAGFYDQFDVVGSGNNVRVNDDGIAQQVALTLDQGNGGSGFSSKDKYLYGEFSVQMKLIGGNSAGTVTSFYLTSGEGDGHDEIDIEFMGNLSGDPYVMNTNVWASGDGKKEHQFYLWFDPTADFHTYKIVWNPKNIIFQVDDVPVRTFKKYDDLPYPSSQPMTVHATLWDGSYWATRHGDVKIDWTQAPFVVNYRGYTSNGCVSNGGSSACPAGSDAWMSTELDAKALGTVAWAESKYMSYDYCTDGWRFPNGFPAECSRRN

SEQ ID NO: 9857 - protein, 321 aa, Streptococcus pyogenes M1 GAS
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLIALGIPVILVSRCFNGMAEPVYAYEGGGAMLQEAGVMFVKELNAPKARLKLLIALNAGLTGQELKDYIEG

SEQ ID NO: 9858 - protein, 196 aa, Yersinia mollaretii
SIGGWKGINESDMVLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 9859 - protein, 497 aa, Brucella suis 1330
MTQENKMGKHENKAGGASLLHYGNFIAGQWQDAVGGEHITLKNPSDGSDLAPIARGAKADIDLAVVAARSALSGDWGKLTATERGRILHRISEEVLKNIDLLTDLESKDVGKPVTQARADVVALARYLEFYGASADKVHGDTLPYQNGFTVLSIYEPHGVTGHIIPWNYPMQILGRSLGAALAMGNAAVVKPAEEACLTILEFARIAEKAGLPKGALNVVTGFGAEAGAALCEHPDVNHISFTGSVRTGEVVQAAAAKNTVPVTLELGGKSPQIVFADADLDRALPFLVNAGIQNAGQTCSASSRILVERSIYEEVIARMSERYRALKVGPASADLSVGPVVSQRQKAIVDGYLDLAKESGLAIAAQGVLAEGAPEGGAYVLPTLIRDVPADHRLAQEEIFGPVQVILPFDTEEEAIAIANGTHYGLVCGIWTNDGGRQFRLAHAIHSGQVFINNYGAGGGIELPFGGVKKSGHGREKGFEALYGFASLKTISVYHG

SEQ ID NO: 9860 - protein, 460 aa, Zea mays
VFSEVLFFIYLLPPIIFNAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNALQNFDLNHIDVAVVLNFLGNFCYLFVSSTLLGVFTGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDSPGKSIGISSILLGLVLLGRAAFVFPLSFLSNLTKKSPLEKITFRQQIVIWWAGLMRGAVSIALAYNKFTRSGHTELHGNAIMITSTITVVLFSTMVFGMMTKPLIRLLLPACSNTATSEPSSPKSLHSPLLTSMQGSDIETGSAQIVRPSSLRMLLSKPTHTVHYYWRKFDDALMRPMFGGRGFVPFSPGSPTEQSVHDGR

SEQ ID NO: 9861 - protein, 214 aa, Bacillus cereus ATCC 14579
MIKIAPSILSADFSKLGEEIKDVEKGGADYIHVDVMDGHFVPNITIGPLIVEAIRPITSLPLDVHLMIENPDNYILTFAQAGADIITVHVEACPHLHRTIQLIKSHGIKAGVVLNPHTPVSVIEHVLEDIDMVLLMTVNPGFGGQKFIHSVLPKIKQVADMVKERNLEVEIEVDGGVNAETARLCVEAGANVLVAGSAVYNQKDRGEAIRVIRG

SEQ ID NO: 9862 - protein, 251 aa, Zea mays
RYPWDPLSAGGAGVGSPGQVVGDSFRFNLEEVECATQYFSDVNLLGKSGFAAATYKGILRDGSVVAVKSLSKTSCKQEELDFLRGLKMLTLLQHDNLVSLRGFCCSRGRGECFLVYDFMVNGCLSRYLDVKDGSSGATVLDWPTRVSIIRGIAEGIEYLHSKKGSKPPVVHQNISADKILLDHHLAPRLSVPGLHKLLADDVVFSALKASAAMGYLAPEYAATGRFTDKSDVFAFGVVVLQVLTGRRDVSQ

SEQ ID NO: 9863 - protein, 337 aa, Nicotiana tabacum
MAKVKIGINGFGRIGRLVARVALQRDDVELVAVNDPFISVEYMTYMFKYDSVHGQWKHHELKVKDDKTLLFGEKAVTVFGFRNPEEIPWGQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVSWYDNEWGYSTRVVDLIKHMASVQ

SEQ ID NO: 9864 - protein, 494 aa, Zea mays
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 9865 - protein, 544 aa, Haemophilus somnus 2336
MKFNDIKRLYKIVRVFLSYGIDEILPHNKYTRSIRCWRMLFFWLKNKHNNKAFGLRLRLALQELGPVWIKLGQMLSTRRDLFPAEIADELALLQDNVEAFSGKIARQQIEQALGSSLENWFTDFDENALASASIAQVHTAKLKLGEEQEKEVVIKVLRPNIQPQIEADLSWMYKLAGLLPKLFREGYRLRAVEVIQEYEKTLRDELDLRVEMANAIKLRENFLDSPMLYIPKMYEAFCHKNVIVMERIYGIPVSDVETLQRNGTDMKLLAERGVQVFFTQVFRDSFFHADMHPGNIFVNPLRPENPQYIGIDCGIVGKLNESDKRYLAESFVAFFNRDYRRVAQMHVDAGWTPQDTNIDDFEQAFREVCEPIFAKPLSEISFAQVLLNLFNVAREFNMQVQPQLVLLQKTLLYIEGLGRQLYPQLDLWDTAKPFLQNWLNEQIGMKATFKKLKAKLPYLQEHLPDFPETLMDALKQQKFISQQLVEINKKLAKQQRWQKKMFVLIVGIVIFSVTLWQFAALPLAISAGLFLVGFLVWLIGFLLP

SEQ ID NO: 9866 - protein, 327 aa, Burkholderia fungorum
MSVSTELSKDELLKAYRMMRTIREFEERLHVEFATGEIPGFVHLYAGEEASAVGTMLHLNDADYVATTHRGHGHCIAKGVDVRGMMAEIYGRKTGVCHGKGGSMHIADLSKGMLGANGIVGAGGPLICGAALAAKYKKSGGVGVCFFGDGASNQGVIFESMNLASVWRLPAIFVAENNGYAEATSSTWSVATDNIADRASGFGMPGVIVDGFDFFAVHEALGEAIERARHGGGPTLVEVKFSRYFGHFEGDAQTYRAPGEVQKLRDEKDCLKRFEERVVRAGMLSADQLRGVDAEVKTLIDTAVTEAKAAPLPTAEDLLSDVYVSYP

SEQ ID NO: 9867 - protein, 297 aa, Shigella flexneri 2a str. 2457T
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVIIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 9868 - protein, 251 aa, Polygonum hydropiper
AYNQFSSDIPVISLAGIDDVGGKREEICGKIVAACEDWGVFQVVDHGVDTQLVSEMTRLAREFFALPAEEKLRFDMTGGKKGGFIVSSHLQGEAVQDWREIVTYFSYPIKNRDYSRWPDTPEGWLKATEHYSEQLMGLACKLLGVLSEAMGLEAEALTKACVDMDQKVVVNYYPKCPQPDLTLGLKRHTDPGTITLLLQDQVGGLQATRDDGKTWITVQPVEGAFVVNLGDHGHFLSNGRFKNADHQAVVN

SEQ ID NO: 9869 - protein, 438 aa, Neurospora crassa
MADLLYDLLSPSFSGDPSSRPAPDSSSLEYLTSLSSQPLTALETTEPQALAQTSHGLLLSIQALSKKSHKQVIESATHHSTLRTSLPALAASTADLRHSIPKLDHEAVRFSTNYSKSSESDVLLRRKKALLLSRNVERLVDVLELPNLLSTAISTAPVNYSSALDLNGHIRRLHSLYPDSPLVTSIAAQADEAMRTMAANLIQSLKSPGLKLAASLRTISWLRRVLPDLEAAGTSKGHDSQERVLGALFLVCRLATLVNMLDALEPLRDLADQEKARQKAIGSGNAWSGGQQTERYLKRYIEIFREQSFAIVSMFRSIFPPAAPKGNGNENLDDPLKQQDALEPMPAALATFPLHLVDMLLETLRLYLPTVKDQASRDSLLTQVLYCAGSLGRLGGDFGLFLASLDLGPEAEEEWVEVVKRHRALAGRLESIVGDQKK

SEQ ID NO: 9870 - protein, 485 aa, Pseudomonas fluorescens PfO-1
MNNTKVLNWIDGLWLDSGDYKDSIDPATYELIGRYAEGGLAEAQQGIEAAQRAFTQTPWKDDSQLRAQVLLELADVFELNAAELIDTLALENGKIRPEAAFEVGMVPSKLRYYAALARTEYGRAAQPRPGKISLVIRQAVGVAGIIVPWNSPVVLMIRSLAPALAAGCTTVIKMPGQTAQTNALVARIMSEAPSLPRGVINLFSEQGATGSIHLVESPKVPVISFTGSTGTGRAISAAGAQHLKRFGLELGGKTPMLVFNDADLDAVAPTLVKALTVFSGQFCMTGSRLLVQRDIAHVLTERLAARLEAVRVGPAADPDSDMGPLIDKPNVQRVNQVVEEAIAAGAQVIVRGGPVTEGPLAKGAFYRPTLLRVSDPEMAIVQRETFGPVLTLQVFDSEAEAIELANNSEFGLAASVWTRDIDRSLRVARELEAGTVWVNDWAVVYDEFEEGGFKQSGQGRLNGVAAMDDFVEYKHIALNPGRRQE

SEQ ID NO: 9871 - protein, 2376 aa, ASPERGILLUS NIDULANS FGSC A4
MSNETFYLLPLNDDGSPDVPGGFIYLPPPDHPKYSLRFLIEGSSSICRDGTLWINIPEIGKSFDRQSFRPFKLYPDFSRNIQIDVPVTCPGSFAYYVTYSPLPEFTITSSAPVKPARTPTHYIDVSPRLSLAGEGIPLNALSIFSVNSKFMGKYPEDWNQYLNSISRRKYNMVHFTPLMKRGASNSPYSIFDQLQFDDIAFPNGENDVQKLIKDMEEKHSLLSLADVVWNHTANNSKWLEEHPEAGYSVETAPWLEAALELDTALLKFSHELQKRGLPTDFKTVDDLTLVMNEVKNHVIEDLCLWEFYVLDVKSNARRVIDEWKVSTNSDIERGRWAQLDLGAYKAWSLEDQASLIRQKGVPTAGQILGRYSREIDTQLGVAIATALFGNFDATSSDLTAVENTLRKLLDVVNVPFYKEYNSDVTEIMSQLFNRIKYLRIDDHGPKLGPVTDQNPLIESYFTRLPLNEITKKHSPKALALANNGWIWNADAMRDNAGPNSRAYLRREVIVWGDCVKLRYGDGPEDNPFLWDFMARYTRLMAKYFSGFRIDNCHSTPLVVAEYLIDEARKIRPDLAIFAELFTGSEEADYIFVKRLGINALIREAMQAWSAGELSRLVHRHGGRPIGSFELDLPSPGLDLSKSQVSGSEREIIRSIRPIPVPALFMDCTHDNEMPAQKRTATDTLPNAALVAMCDSAIGSVMGYDEVYPKIVDLVHETRLYSFFDLPESPTLDELVNLKGISGLKRLLNELHTMMGQMGYDETFIHHDGEYITVHRVHPQTRKGIFLIAHTAFPGQNSGALLAPIHLAATRAKPIGSWLLKVQELSDDKERALSDKVYLQGLPSEVLKIEGARIEETDRETIISVLDPFIPGSIALFETSIPSLEHADELSNDAITDGAVEAFSELSLIDLNFVLYRCDAEERDSSGGQDGVYDIPNHGPLVYAGLQGWWSILEGIIRYNELGHPLCDHLRQGQWALDYIVNRLMKATKNPQYAALRRPAEWLEAKFQIVRGLPSFLLPRYFAIIVQTAYVAAWNRGIQLLGDDVRVGQAFTQQLAMVSVQQTGFVNSASLWPKKSVPSLAAGSGKLPRYNSRDSIWFLLQAIQDYTKMAPDGLELLQDKTPRRFLPYDDTWFPFDDPKAYSQTSTIVDIIQEVFQRHAQGISFREYNAGPELDVQMKSEGFNIDIRVNWETGLIFGGSQHNCGTWQDKMGESEKAGNKGVPGTPRDGAAIEITGLLYSALKWVTELNKQGLFPYDKVDIGNGKSITFEGWAAKVKTNFERCYYIPLDPNDDDQYDIDSGIVNRRGIYKDLYRSGKPYEDYQLRSNFPIAMVVSPELFDPSKALGALAIADSVLAGPLGMATLDPSDLNYRPDYNNAEDSTDFATSKGRNYHQGPEWVWLRGYFLRALLYFDLARRKTADERTEAFQQVTRRLAGCKKALRESPWKGLTELTNRNGNHCADSRPSIVKTNCRYSLASKTRSPLQGGLREYHVWYCYRSLALDKPDCSSTVVRLEKQHSASQCFNNGANPSTHLRRQEPPLHKAMSLTESVAAMATAITVANHHGTNNGTDDDGPGRKWDDQLKGDLYTQLVISLALGITAFLSFCFLRPKWTELYAARRRQRRAALYLPELPDSFFGWIPVLWKITEEQVLQSAGLDAFVFLSFFRFAIRFTSTVFILAFVVLLPIHYSYTKKLGIPDWDKSIDVGEDGKKKFIDDPPYLWTYVVFTYIFTGLAIFMLFQETKKIIQTRQKYLGSQTSTTDRTIRLSGIPAEMGSEENIREFIEGLHIGEVESITLCRNWSSLDHLIEERLKVLRNLETSWVQYLGYKRVRKSGDTLPLRRQPIDSSIFSEDDERMRLLLENGQDDAFDRSRKRPMVRLWYGPLKLRYRKVDAIDYYEERLRRLDEEIQSARQKEYPPTELAFVTMKSIAAAQMLVQAILDPHPMKLLARLAPAPADVIWKNTYLPRARRMFQSWSITVLICFLSVFWSVLLVPVGTLLKWETLHKVLPQLADALARHPLVKSLVTTGLPTLAFSLLTVAVPYLYNWLSNHQGMMSRGDIELSVISKNFFFSFFNLFVIFTVIGTATNFYGLWEHLRDSFKDATTIATALANSLENLAPFYMNVFVLQGLGLFPLKLLEVGSVFLYPINYLMAKTPRDYAELSTTATFSYGYSIPQSILILVICVIYGVFPASWLICFFGLVYFTIGNFIYKYQLLYAMDHRQHSTGRAWPMICNRVLVGLVVFQLAMAGTLGLRKAITLALLIVPLIGATVWFSYFYSQSYEPLTKFIALKSIYRDTPTSGDISPSTTSTFSPPLALDRDAFPIRLGGQVLGLKLKRYVNPSLILPLDSAWLPGRNPMPELQEDFEYYEDQNHVSV

SEQ ID NO: 9872 - protein, 488 aa, Giraudia sphacelarioides
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYACTIGSVIVMIDLVIGYTAIQSMAIWARQNEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATSCGPLKAALDLWKDITFDYTSTDTPDFVEVATESR

SEQ ID NO: 9873 - protein, 199 aa, Zea mays
MEDEEHEVYGQEIPVDGEDVDMSAGDDATKLQELDEMKRRLKEMEEEAAALREMQAKVAKDMQDPNATTSENKEEMDSRSVFVGNVDYACTPEEVQQHFNSCGTVNRVTILTDKFGQPKGFAYVEFVEVEAVQEAIKLNESELHGRQLKVAPKRTNVPGMKQPRGRGFNPYRPYGYSPYGYGYGYGRFPRFRRPRRPYF

SEQ ID NO: 9874 - protein, 470 aa, Schizocladia ischiensis
  unsure (1)..(470): unsure at all Xaa locations
GVIPYAKMGYWDADYVVKDTDLLALFRLTPQPGVDPVEAAAAVAGESSTATWTVVWTDLLTACDIYRAKAYRVDPVPGTTDQFFAYISYECDLFEEGSLANMTASIIGNVFGFKALKALRLEDMRIPFAYLKTFQGPATGLIVERERLDKFGRPFLGATVKPKLGLSGKNYGRVVYEGLRGGLDFLKDDENINSQPFMRWQERFLYTMEGVNRSSAATGEVKGSYLNVTAATIEQMYERAEFAKGVGTVXVMIDLVIGYTAIQTMAIWARKADMILHLHRAGNSTYARQRNHGINFRVICKWMRMAGVDHIHAGTVVGKLEGDPLMVKGFYNTLLLTELKVNLSQGIFYDMSWASLRKVVPVASGGIHCGQMHQLVYYLGDDVVLQFGGGTIGHPDGIQAGATANRVALESMILARNEGRDYLNDGPEILRNAAKLCGPLKTALDLWKDITFNYTSTDTPDFVETATESK

SEQ ID NO: 9875 - protein, 343 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 9876 - protein, 310 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYD

SEQ ID NO: 9877 - protein, 297 aa, Triticum aestivum
MKGGGAIRSGGGGGGGLMRTRLRLPVVLLSCSLFFLAGFLGSLLFTQDPQGEEDVERPLRRERLMEAVWPEMAYGESGEPTPSLIPYQILSWQPRALYFPQFATAEQCENVVKTAKARLRPSTLALRKGESEETTKGIRTSSGTFLSAEEDPTGALAEIETKIAKATMMPRSHGEPFNVLLYEIGQKYASHYDAFDPAQYGPQKSQRVASFLLYLTDVEEGGETMFPYENGDNMNIGYDYEQCIGLKVKPRKGDGLLFYSLMLNGTIDPTSLHGSCPVVKGEKWVATKWIRDRGSTS

SEQ ID NO: 9878 - protein, 205 aa, Petunia x hybrida
MGRKKVEIKLIQDKNSRQVTFSKRRKGLIKKAKELSILCDADVAVVVFSNRGRLYDFSSNNSLTEIVQRYHSHVEAEKEISAEASDAEQSKYASIMTIGEMLQTIQRQLEEPDVDDLNVTDLVHLENQIQTALMEARSRKTHLMMESLKSLHEKENLLREENRILADKISMTTNTREVNGMDLDFTNLATIQPIGEQQRATLNFF

SEQ ID NO: 9879 - protein, 140 aa, Zea mays
  unsure (1)..(140): unsure at all Xaa locations
MDATKDRPCSSHHTTATTTNAGAHVRNDNEALTAGPGGPILLEDYQQNERGGHFDXRERIPERERHARGXAATGLIPVHPDEKALTCANXLSAPGVRTLEIELSSTATHERGTXQTIRDPSGYQRRSNTTPRATGTLLGN

SEQ ID NO: 9880 - protein, 186 aa, Halobacterium sp. NRC-1
MSSLADTIHIENVVASSDLGQELALDQLATDLDGAEYNPEDFPGVVYRLQEPKSATLIFRSGKVVCTGAKSVDAVHDALEIVFDDLRELGIDVDSTPPVKVQNIVSSASLEQSLNLNAIAIGLGLEQIEYEPEQFPGLVYRLDDPDVVVLLFGSGKLVITGAAESADAQHALAHVNDRLTELGLLE

SEQ ID NO: 9881 - protein, 440 aa, Zea mays
MEMHADVDGCSVPLAVLLKRELCNQKVERPDILFGEANKSKKGEDFTLLVPRCHRTPGGSGGGENAGDDDTISVFAIFDGHNGSAAAIYTRENLISSVLAAIPPNLTSEEWKAALPRALVAGFVKTDKNFQIKAARSGTTVTFVIIDGWVVTVASVGDSRCILESAEGSVYFLSADHRLDANEEEVERVTASGGEVGRINIAGGAGIGPLRCWPGGLCLSRSIGDIDVGEFIVPVPHVKQVKLSNAGGRLVIASDGVWDALRFQEALNYTRGLPAEAAANRIVKEAVTSKGLRDDTTCIVVDILPPEKLSPPLKRPGKGVIKALFRRRPSDEMSEDQMDRGCLEIDVVEEIYEEGSAMLARRLNINYPEGNMFKLHDCAVCQLEMKPGEGTSVHGNMPKHSRVDPWGGPFLCSSCQLKKEAMEGKLHSRNSQSAVQPLPK

SEQ ID NO: 9882 - protein, 205 aa, Bacteroides thetaiotaomicron VPI-5482
MLIIGIAGGTGSGKTTVVRKMIESLPVGEVVLLPQDSYYKDSSHVPVEERQNINFDHPDAFEWSLLSKHVMMLKEGKSIEQPTYSYLTCTRQPETIHIEPREVVIIEGILALCDKKLRNMMDLKIFVDADPDERLIRVIQRDVIERGRTAEAVMERYTRVLKPMHLQFIEPCKRYADLIVPEGGSNAVAIDILTMYIKKHLKNEE

SEQ ID NO: 9883 - protein, 212 aa, Synechocystis sp. PCC 6803
MTSYSSATARAEMSELRRLKSLLPPELQSWVMVEGSTEVNPPLIRSEELGRDEIEIQVDLAKWENLAIDQRNLLFWHEVARIQSDTIPREGWEMAALAIGLGGAVGELWVQDGLLLLLALGLCGISGYRLWQKNNGEKRIKEAIEADEKAITLATRFGYTLPNAYKSLGSAFKTLIEQTPNRRQRKQYETRLQALRQSAAKMKAKTQKAKAL

SEQ ID NO: 9884 - protein, 193 aa, Bifidobacterium longum DJO10A
MAQSDITIDALSKVGQQDAEYLVSLVRSVPGFPKEGIIFRDFMPVLADPKGLKILLKALEEALPVSPSEFDSIAGLESRGFLFGPAMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 9885 - protein, 371 aa, Nicotiana tabacum
MAKRTLPLLRHLLSSPSHGFSHSLTSTRSVTYMPRPGDGTPRAVTLIPGDGIGPLVTGAVEQVMDAMHAPVYFERYDVHGDMKSVPPEVMESIRKNKVCLKGGLKTPVGGGVSSLNVQLRKELDLYASLVHCFNLQGLPTRHENVDIVVIRENTEGEYSGLEHEVVPGVVESLKVMTKFCSERIAKYAFEYAYLNNRKVLTAVHKANIMKLADGLFLESCPEVATKYPGIKYNEIIVDNCCMQLVSRPEQFDVMVTPNLYGNLVANTAAGIAGGTGVMPGGNVGADHAVFEQGASAGNVGNEKILEQKKANPVALFLSSAMMLRHLQFPSFADRLKTSVKRVIAEGKYMTKDLGGNCTTQEITDAVIANLD

SEQ ID NO: 9886 - protein, 333 aa, Nitrosomonas europaea ATCC 19718
MTIRIGINGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNEWGYSCKLLEMVRVIASK

SEQ ID NO: 9887 - protein, 716 aa, Claviceps purpurea
MVRTSLAAFSLAVAGLASAQCPFADPGRLAARAQGLDESSRGHLAGFEVDDSEGYLTSDVGGPIEDQNSLKAGDRGPTLLEDFIFRQKITHFDHERVPERAVHARGTGAHGTFTSYGDYSNITAASFLGQKDKKTPVFVRFSTVAGSRGSADTARDVHGFAVRLYTDEGNFDIVGNNVPVFFIQDAIQFPDLIHSVKPRQDNEIPQAATAHDSAWDFFSQQTSTLHTLFWAMAGYGIPRSLRHMDGFGVHTYRLVTDDGTSKLVKWHWKSKQGKASLVWDEAQRAAGKNADYHRQDLFDAIQSGNYPEWELNLQIINEDQALAFGFDVLDPTKIIPEEYAPLMPVGVMRLDANPSNYFAETEQVMFQPGHIVRGVDFTEDPLLQGRIFSYLDTQINRHGGPNFEQLPINRPVVPIHNNNRDGAGQNFIHKNNAPYTPNTLNKGFPKQANQKEGKGFFTAPGRKVSGSLQRRLSNTFLDHWTQPRLFFNSITPIEQQFLINAIRFETSHLSQVVQKNVLAQLNKISHDVAVRVGKALGLDAPPADDKYYHNNQTKGLSIFGEELPTIATLIVGVLASTASKNSLAQAQALKDAFKTREVNVIVVAESLATGVDQTYDAADAVSFDGIVVADGVEALFDNTKKSSLFQPGRPSQIVNDGYNWGKPMGFLGSAKRAVKATSVVEGAGVYMRNSTATLVGDFQKGLAKFKFTDRFPMDTK

SEQ ID NO: 9888 - protein, 541 aa, Hordeum vulgare
LTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGEARRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNGLLSGSKAQQGLDFGPWHKELDQQKREFPLGYKTFGEAIPPQYAIQVLDELTKGEAIIATGVGQHQMWAAQYYTYKRPRQWLSSSGLGAMGFGLPAAAGASVANPGVTVVDIDGDGSFLMNIQELALIRIENLPVKVMILNNQHLGMVVQWEDRFYKANRAHTYLGNPENESEIYPDFVTIAKGFNVPAVRVTKKSEVSAAIKKMLETPGPYLLDIIVPHQEHVLPMIPSGGAFKDMIMEGDGRTSY

SEQ ID NO: 9889 - protein, 431 aa, Prochlorococcus marinus str. MIT 9313
MKRVLAIILGGGAGTRLYPLTKMRAKPAVPLAGKYRLIDIPISNCINSSINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESARNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGQGTTVKGAILDKNTRIGNNVTIVNKDHVEEADRADEGFYIRNGIVVVVKNATISDGTVI

SEQ ID NO: 9890 - protein, 306 aa, Lycopersicon esculentum
MGGGDHGGKSDISFAGIFASSAFAACFAEACTLPLDTAKVRLQLQKKAVEGDGLGLPKYRGLLGTVGTIAKEEGVASLWKGIVPGLHRQCIYGGLRIGMYEPVKNLYVGKDHVGDVPLSKKILAALTTGALGITVANPTDLVKVRLQAEGKLPAGVPRRYSGALNAYSTIVKQEGVRALWTGLGPNIGRNAIINAAELASYDQVKEAVLRIPGFTDNVVTHLIAGLGAGFFAVCIGSPVDVVKSRMMGDSAYKNTLDCFVKTLKNDGPLAFYKGFIPNFGRLGSWNVIMFLTLEQAKKFVKNLESP

SEQ ID NO: 9891 - protein, 444 aa, Oryza sativa
MATHAALAASRIPATARLHSKAASKQRVDFADFSGLRPGSCSISHAAREASFSDVLGSQLVARATGENAVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 9892 - protein, 804 aa, Aspergillus niger
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESIAAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTNVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEDLASITQLPVLNFTANIRNTGKLESDYTAMVFANTSDAGPAPYPKKWLVGWDRLGEVKVGETRELRVPVEVGSFARVNEDGDWVVFPGTFELALNLERKVRVKVVLEGEEEVVLKWPGKE

SEQ ID NO: 9893 - protein, 335 aa, Thermotoga neapolitana
STFVAGLEKLKKGEIEPYGVPLAGELPIDFKDIRIVGSYDVDRAKIGKKLSEVVSQYWCDVNSLSDDPVVSTGVHLGSVKNLPIEAEGLEDSMTLKEAIERLVDEWSKLDPDVIVNTCTTEAFKPFGNKEELLKAIENNDKERLTATQVYAYAATLYAKKRGGAAFVNVIPTYIANDPAFVELAKGNNLVVFGDDGATGATPFTADVLSHLAQRNRYVKDVAQFNIGGNMDFLALTDEGKNKGKEFTKSSIVKDILGYDAPHYIKPTGYLEPLGDKKFIAIHIEYTSFNGATDELMISGRINDSPALGGLLVDLVRLGKIALNRKEYGTVYPVNA

SEQ ID NO: 9894 - protein, 325 aa, Methanopyrus kandleri AV19
MLFLSEDHVRALLDVREVVERVEETFRIKPECEMPPKTIVPLEGGDFRVMPAYLSELGVAGVKIVNSHPDNPDRGLPTVMAVMCLIEPETGRPLCLVSATEITSLRTGAAGAVASKYLAEDVRTVGIVGAGVQGRYQLLTHAEVFDLEAVFVYDQAREAARRLAEWVERDLGVDAKVLDNLDFSGLDVDVVCTCTPATEPYLGSEDVPEDVHVNAIGADAPEKQEVKTELLKRAVVVVDDREQCVESGDVSQPVERGELNPEELIELSDVVRGETEVDSSELTVFDSTGIAILDVAVGALAYERAKKTDAGVEVKPFELPTGNFK

SEQ ID NO: 9895 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGPPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGAIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 9896 - protein, 243 aa, Zea mays
MSVPMYNKQNSLGTPPPHKTNPFSDSEGPSRAQSVPVRRTNQSVQELEDYAITKARETTHKVNDCVRAAEAIREDATQTMLTLHRQGEQIMRSHQVAADIEQDLTVSEKLLGSLGGLFSKSWRPKRNHQIKGPVSGNNYSATTANDTEQRGKLGIAPARQEYPSHVQTTPVSAMEKVQAERTKQDDALSDLCSTLGQLKEMAVDMGTEIDRQNKALVPLSDDVDELNFRLKGANQRGRRLLGK

SEQ ID NO: 9897 - protein, 287 aa, Tropheryma whipplei TW08/27
MGLDNLKVGLAQMLKGGVIMDVVTPDQAKIAEDAGAVAVMALEKIPSDIRASGGVSRMSDPGLIERVMDSVSIPVMAKVRIGHFAEAQILQSLKVDYIDESEVLSVADSSYHIDKRKFTVPFVCGATNLGEALRRISEGASMIRSKGEAGTGDIAQATKHIRAILSEISALTQAREDELPARARELGAPIDLVRETARLGRLPVVLFTAGGIATPADSSLVMQLGSDGVFVGSGIFKSEDPKAYAAAIVQATAQYDDADLLARVSRNLGQAMPGVSNLDVRFSSRGV

SEQ ID NO: 9898 - protein, 171 aa, Mycoplasma fermentans
MDLKKYIRDIENFPKTGIMFKDISPLLANGKALNYTITEMAKLAQDVDVIVGPDARGFLFGTPTAAFLKKPFIMVRKPGKLPGDVISKSYDLEYGNNVLQIQKGFIKKGQTVAIIDDVLATGGTTKAIIKLLEEQGAIVKKVILLLELVDLNGRQLITKDNDIEIVSLVKF

SEQ ID NO: 9899 - protein, 112 aa, Oryza sativa
  unsure (1)..(112): unsure at all Xaa locations
VECTSAAIQALXTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVNSFL

SEQ ID NO: 9900 - protein, 482 aa, Pseudomonas aeruginosa UCBPP-PA14
MSLEQTGHAPATSGVDFESVDADYFQHRQLKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVALALACVAVVAGFLVDPRVVVGAVAIYAVLIGYFALYSRHHLVSGTPEEEFAAIQAAEQDLR

SEQ ID NO: 9901 - protein, 159 aa, Eremothecium gossypii
MSRELVTVDEVYPTAVGTFDVIVKKSSQKEYSDEFGKELFSSKKDDKSTLYSQLAFYGEVAVGAVKARIQDMRGHSAVVIDTLAVLEAYRGKGVGTKLLDYVEKETKPFQPRAIYVTVAASATGELQWYQSHGFELLGDKSGSCENGSQAERNLVKWLV

SEQ ID NO: 9902 - protein, 468 aa, Oryza sativa
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTMLTMFNALLDSYQVLGNAKGAVAVVVSILIFRNPVTFMGMLGYGITVAGVVLYGEAKKRSKAGMFSFAVSAAAAAAAATTGQGWGIRRPDGLEPFPWVSASALVGAWSLLFLREGDNEEDRVLKLSDVWLIFPTVEAVEAPETTELKLSTELLGEMLGDTRLLLPPVGILFLDALAGILPIEAAVAAADDDNDDGKAPDFEVEQLLVEPSEVSKMVLLL

SEQ ID NO: 9903 - protein, 350 aa, Magnetospirillum magnetotacticum
MMTGVGQPMVKEPMELAAPGAGEVLVEVAGCGVCHTDLDYYFNGVRTNHALPLALGHEISGRVIKAGSGAESWVGKAVIISAVIPCGQCDLCKRGKGTICRSQKMPGNDLQGGFATHITVPANGLCEVDEARLKATGLELSEVSVVADALTTPYQAAVQAGIGQGDLVIVIGCGGVGGYSVQVATAMGAKVVALDIDPVKLEAVKAAGAALTINPKDFPSTREIKKEIGAFAKANGLRSTEWIIMECSGSVPGQQSAFDLMVHGCTICVVGYTMNKAEFRLSNLMAFHARALGNWGCPPDLYPGALDLVLSGKINVKNFVERRPLDSINDTFAAVHDHKLSRRAVLCPNT

SEQ ID NO: 9904 - protein, 217 aa, Triticum aestivum
  unsure (1)..(217): unsure at all Xaa locations
MCTTCSWRSAPAEATGTRARRLGRDDNEGRNPPAVTGPPGAVGDGPTRIRVLPXFLKKAMMFNDMMTVLLDYPLFKDDADMLAXSYRRTAISATPGIEARGFIFGLLIALGAVAKFIPLRKPKILPGDVISDTYVLEYRTDCLEMHVGAIEPRERVLIVDELAATGGTLCAAIHLLERAGADVVECACLIGLPKFKDFYKLNGKPVYVLVESLEYEK

SEQ ID NO: 9905 - protein, 150 aa, Arabidopsis lyrata subsp. petraea
HITTPTSASDKRSKDKVFEVLNRCGKKVEDVTRKAEALAGGLKDHLKFSPSIGDAAMARLSQGTKMIVEGGPERVFQREFGVLAAEKLLDSFVCYISTTWGPVTGVIYISNRRIAFCSDYAIRLPSSVGGNGVAAYYKVVMEWEKIRSIS

SEQ ID NO: 9906 - protein, 468 aa, Chorda filum
IPYAKMGYWDADYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPYAYLKTFQGPATGVIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAASTCGPLKAALDLWKDITFDYTSTDTPDFVEQATESK

SEQ ID NO: 9907 - protein, 117 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 9908 - protein, 126 aa, Zea mays
YNHVLQVDYACTPEEVQQHFQACGTVNRVTILTDKFGQPKGFAYVEFLEQEGVQEALNLNESELHGRQIKVAPKRTNVPGMKQRPPRGYNPYHGYPYRSYGAPYFPPYGYGRAPRFRRPMRYRPYF

SEQ ID NO: 9909 - protein, 514 aa, Escherichia coli O157:H7 EDL933
MKIRSQVGMVLNLDKCIGCHTCSVTCKNVWTGREGMEYAWFNNVETKPGIGYPKNWEDQEEWQGGWVRDVNGKIRPRLGSKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSIAQVEEMYRYLAIANYEDRFVIPTSHREMAGDAFAERNGCGFTFGDGCHGSDSKFNLFNSSRIDAINITEVRDKAEGE

SEQ ID NO: 9910 - protein, 223 aa, Oryza sativa (japonica cultivar-group)
MIERPELRWAFIRKVYAIVATQLVVTVAIAAAVYSVPAIRRFFLARTPASLAAFVLVIVAPLIVMLPTMFLRKKHPINLILLALFTICMSCAIGLGCLSSKAGIAIIEAASLTFGLVFGLTLYTFWAAKRGHDFSFLRPFLVAAFLVLVLYGLIQMLVPTGKVATTVYGCVAALVFSGFIIYDTDNLIKRHAYDEYVTAAISLYLDTVNIFIAIFTALDASDS

SEQ ID NO: 9911 - protein, 199 aa, Pyrodictium occultum
MESFVTPQRRSAAEQEPKPTANIENIVATVSLDQTLDLNLIERSILTVEYNPEQFPGLVYRLDSPKVTALIFKSGKMVVTGAKSTRDLIEAVKKIVRNLKKHGIQIYGRPKVQIQNIVASANLNVCVDLERAALTLENSMYEPEQFPGLIHRMDEPRVVLLIFSSGKMVITGAKREEEVYEAVNKIYEKLKKLRAIRPC

SEQ ID NO: 9912 - protein, 511 aa, Streptomyces coelicolor A3(2)
MTEDAKASGLSDEERLAQLGYTQVLARRMSAFSNYAVSFTIISVLSGCLTLYLFGMNTGGPAVITWGWVAVGLMTLFVGLAMAEICSAYPTSAGLYFWAHRLAPPRTAAAWAWFTGWFNVLGQVAVTAGIDFGAASFLGAYLNLQFDFEVTPGRTILLFAAILILHGLLNTFGVRIVGLLNSVSVWWHVLGVAVIVGALTFAPDHHQSASFVFGEFVNNTGWGSGVYVVLIGLLMAQYTFTGYDASAHMTEETHDASTAGPKGIVRSIWTSWIAGFVLLLGFTFAIQSYDGALTSPTGAPPAQILLDALGATAGKLLLLVVIGAQLFCGMASVTANSRMIYAFSRDGALPYSHIWHSVNPRTRTPVAAVWLAALAALVLGLPYLINVTAYAAVTSIAVIGLYIAYVIPTLLRVRKGAAFERGPWHLGRWSQLVGVVAVTWVGVITVLFMLPQVSPVTWETFNYAPIAVLAVLGFAATWWLVSARHWFLNPDHERTRTRAAARASAPEPVDP

SEQ ID NO: 9913 - protein, 646 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGS

SEQ ID NO: 9914 - protein, 474 aa, Prochlorococcus marinus str. MIT 9313
MAQFEKLSPPSQGTAIRFVNGQPVIPNEPIIPFIRGDGTGVDIWPATQRVLDAAVTKAYQGVRRIEWFKVYAGDEACDLYGTYQYLPEDTLEAIRTYGVAIKGPLTTPIGGGIRSLNVALRQIFDLYSCVRPCRYYKGTPSPHKRPQDLDVIVYRENTEDIYMGVEWEADDPVGKTLREHLNTVVIPANGKLGKRQIPEGSGIGIKPVSKHGSQRHIRKAIQHALRLKGDKRHVTLVHKGNIMKFTEGAFRDWGYELATSEFRDVCITERESWILGNLENDPQLSIQANARMIEPGYDSLTPERKASIDAEVHGVLDAIGTSHGNGQWKAMVLVDDRIADSIFQQIQTRPQEYSILATLNLNGDYISDAAAAMVGGLGMAPGANIGENAAIFEATHGTAPKHAGLDRINPGSVILSGVMMLEFLGWQEAADLITKGLSAAIANQQVTYDLARLMDPPVDPVSCSGFSEAVISHF

SEQ ID NO: 9915 - protein, 399 aa, Bacillus anthracis str. A2012
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 9916 - protein, 250 aa, Oryza sativa (japonica cultivar-group)
MDPGGLRPAPQSAAAAAAAAAAGAGAGASAADEPRDARVVRELLRSMGLSEGEYEPRVVHQFLDLAYRYVGDVLGDAQVYADHAGKPQLDADDVRLAIQSKVNFSFSQPPPRECSEFFHSDQDFRSRSLPSDNPLFFSMVLLEVARNRNKIPLPKSIAPPGSIPLPPEQDTLLSQNYQLLAPLKPPPQFEETEDDNAGANPTPTSNPSNPSPNNLQEQQQLPQHGQRVSFQLNAVAAAKRRGTMDQLNMG

SEQ ID NO: 9917 - protein, 225 aa, Listeria monocytogenes EGD-e
MNEINHTSERVNTEKRTEKQIIMQKILNWFVFSLLLASIGAAIGSKLSPELYLPLVVLEVALLITAMVVRRSKTINKVVGYPVVLAFAFVTGLTLGPTLTYYFGAGQGAAVLMAFVTATVTFTTLAFIGAKMKKDLSFLSSALFAAIIILVIFSFVGVFLPLGSMLSTIISAGGTIIFSLYILYDFNQIMKRDVELADVPMLALNLYLDFLNLFMFLLRLFTGRD

SEQ ID NO: 9918 - protein, 275 aa, Xylella fastidiosa Ann-1
MIPISFEFYPPKNDDQRAQLDRTANRLRAFAPEYVSCTFGAGGSTLSYTSETVRHLSQHHGFDTAPHLSCVGGSRQEIRELLKLYRAIGCQRIVALRGDLPSGMGHPGDLRYAADLITFIRAEHGDHFHLEIGAYPETHPQASNTLNDLHYFKAKADAGADAAITQYFYNPDAYFHFVDAVQRLGVTIPIVAGVMPISNFDQLRHFSEQCGAEIPRWITKKMQAYGDDTKSIRAFGADVVTALCERLIAGGAPGLHFYTLNLAKPSTQVLQRLGY

SEQ ID NO: 9919 - protein, 333 aa, Buchnera aphidicola str. Bp (Baizongia pistaciae)
MTIKIGINGFGRIGRVLFRLAQLRSNIEILAINDLINVQYIAYMLKYDSIHGNFNGKIVIKNETLFVNGKKIRITNEKDPKNLMWGDLNIDVVIESTGIFLTTEDSYKHIQAGAKKVIITSPPKDNTPMFVRGVNFNEYVGQKIVSNASCTTNCLAPLAKVINDEFEIVEGLMTTVHATTATQKTVDGVSYKDWRGGRSALQNIIPSTTGAARAVGKVLPELNGKLTGIAFRIPTANVSVVDLTVRNKKIATYEDICQIIKYASNHDMKEVIGYTEDHVVSSDFNGNTLTSIFDAKAGLSLNNNFIKLVSWYDNECGYSSKVLDLSEFISTFS

SEQ ID NO: 9920 - protein, 401 aa, Spinacia oleracea
MASNMLSIANPSLRVYNKGFSEFSGLHTSSLPFGRKGSDDLMAFVSFQTNAVGGKRSSQNGVVEAKLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQ

SEQ ID NO: 9921 - protein, 294 aa, Synechococcus sp. PCC 7942
MTEARRGIILAGGSGTRLYPATYAVSKQLLPVYDKPMIYYPLSTLMLSGIREILIISTPQDTDRFAQLLGNGDRWGLSLSYAIQPAPEGLAQAFLIGESFLNGSPAALILGDNLFHGDDLAVQLQQASQRSQGATVFAYGVADPERYGVVEFDAQQRVLSIEEKPKKPRSRYAVTGLYFYDQQVVELAKQVRPSTRGELEITDLNNAYLQRGHLRVELLGRGMAWLDTGTHDSLLDAASFIQTLEKRQGLKIACPEEIAYRQGWITATQLEQLAEPLRKNGYGQYLLDLLHNPL

SEQ ID NO: 9922 - protein, 490 aa, unidentified diatom endosymbiont of Peridinium foliaceum
MSQSVSERTRIKSDRYESGVIPYAKMGYWDASYAVKTTDVLALFRITPQPGVDPVEAAAAVAGESSTATWTVVWTDLLTACDRYRAKAYRVDPVPSTPDQYFAFIAYECDLFEEGSLANLTASIIGNVFGFKAISALRLEDMRIPHSYLKTFQGPATGIIVERERLNKYGIPLLGATVKPKLGLSGKNYGRVVYEGLKGGLDFLKDDENINSQPFMRWRERFLNCMEGINRAAAATGEVKGSYLNITGATMEDVYERAEYSKEVGSVIVMIDLVMGYTAIQSIAYWARNNDMLLHLHRAGKSTYARQKNHGINFRVICKWMRMSGVDHIHAGTVVGKLEGDPLMIKGFYDILRLTSLDVNLPYGIFFEMPWASLRRCMPVASGGIHCGQMHQLVHYLGDDVVLQFGGGTIGHPDGIQAGATMNRVALEAMVLARNEGADYFNQEVGPQILRNAAKTCGPLQTALDLWKHISFNYTSTDTADFAETPTANV

SEQ ID NO: 9923 - protein, 470 aa, Escherichia coli O157:H7 EDL933
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 9924 - protein, 201 aa, Glycine max
MSSMLRFPFSFPQPRRPQFPRPFTAFAAAVAGASAAVVAVSSSDRSFLRNALNSFFSSDLSMPLWGSLSLADSGVSVVESKTGTSFPSVLDSSQKLCGIGLRKKSILGLKNIDVYAFGVYATDEDIKRHLSEKYGKLSASELQGNKEFTEDLMESDISMTIRLQVVYGRLSIRSVRSAFEVSVGSKLQKFGGSDNKELPDA

SEQ ID NO: 9925 - protein, 197 aa, Raphanus sativus
MGRKKLEIKRIEKKSSRQVTFSKRRSGLIEKARQLSVLCDASVALLVVSSSGKLYSFSSGDNLVRILHRYEKQHADDLKALLDLQSKSLSYGSHNELLELVESKLVESNVGVSVDALVQLEGHLETALSLTRARKTELMLKLVDSLKEKEKLLKEENKVLASQMEKNNLAGAEADNMEIARAQISDINLPVTLPLLN

SEQ ID NO: 9926 - protein, 175 aa, Cicer arietinum
LSVLRSLMPDSYIQRGDQASIIGGAINFVKELEQKLHFLGSKKEEVKSDDVGEGSNKSFSEFFSFPQYSTSGGNSASVIGEKVGEIADIEVTMVESHANLKIRSKKRPKQLLKMVSGLHNMHLTILHLNVTTTCEIVLYSLSVKVEDDCKLGSVDDIAAAVYQMLNRIQQETMLN

SEQ ID NO: 9927 - protein, 409 aa, Zea mays
  unsure (1)..(409): unsure at all Xaa locations
SSGPWPWASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTXDASLTMVMGDDMVKVISWYDNEWGYSQRVVDLADICANQWK

SEQ ID NO: 9928 - protein, 231 aa, SYNECHOCOCCUS SP. WH 8102
MSRTVLITGASRGIGRSVAEHFLAEGHRLCLGLRDPEAVKGTLLDNAHVLPVAYDASQPEQAASLVDAASSWAGGVDALIHCAGILHRTPLLFEDGQDAELEELWQVNVMVPWWLTRAAWPHLRSCGNGRIQVMVSMSGKRVKGRMAGYPLSKFGLMALCQSMRNEGFDHGIRVTAICPSWVNTAMALSVSSVPAQSMTQPRDLACLMGRLLELPDAAVPFEIAVNCALET

SEQ ID NO: 9929 - protein, 100 aa, Oryza sativa; identical to SEQ ID NO: 1830

SEQ ID NO: 9930 - protein, 339 aa, Schizosaccharomyces pombe
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 9931 - protein, 356 aa, Atriplex nummularia
MAAPVCCLPNDDLASRLVQKIAQTVEDEIPEQFLHKDGFPEAKDVPELWTRSLLIDFSLLSSGDQDEIVKFRSALSNWGCFLVKNHGIEGSFLEEVIEVSRKFFSLPFEEKMKYYTDDIFQGYDTDAVCQGLDQQKMNWNDRLFLTMYPKSKGNLKAWPQNPSNFSEIVDEYSKELINLTKGLYKAAAKSLNVREDSFCLEKEGVILSRFTLYPKCPRPKNVLGSKPHLDGSVFTIVLADQEGLEVQKDGQWFKVPVIPGALFVNFGDFGEVLTNGIYKSTMHRVATHSAKDRLSVTAFCTMDATQELTPLTELVTANRPPLYKKFKVYEYKEGVCCKCGPGENAIDAIKLDFPIL

SEQ ID NO: 9932 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 9933 - protein, 141 aa, Triticum aestivum
  unsure (1)..(141): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGVHLXREHNASPGYYDGRTGQCWKLPXFGCTNATQXXNXVEEAKKGT

SEQ ID NO: 9934 - protein, 491 aa, Pseudomonas mendocina
MDTTRPAYQNLELQPLAGQWRAGSSGRPLEVFDPYNDELLLRIALASREDLDAAYRKARDSQREWATTAPAERARVLLEAVKIFDERREEIIDWIIRESGSTRIKAQIEWGAARAITLESASLPNRVHGRIIASNISGKESRVYRAPLGVIGVISPWNFPLHLTARSLAPALALGNAVVVKPASDTPITGGLLLARIFEEAGLPAGVLSVVVGSGAEIGDAFVEHPVPALISFTGSTQVGRNIGRIASGGEHLKHVALELGGNSPFVVLADADVEQAVNAAVVGKFLHQGQICMAINRIIVEQPLLEDFTRRFVERVKALPYGDPSKPGTVVGPVINARQLAGLKEKIATAKAEGATLLLGGEPQGNVMPPHVFGNVTADMEIAREEIFGPLVGIQSARDAEHALELANSSEYGLSSAVFTASLERGVQFARRIHAGMTHVNDIPVNDEPNAPFGGEKNSGLGRFNGDWAIEEFTTDHWITLQHSPRPYPF

SEQ ID NO: 9935 - protein, 352 aa, Brevibacterium sp. HCU
MKAFAMKAQGAALEEIELDRPKPMGREVLLKVTHAGVCHTDTHVQDGGYDLGSRGTLDMSTRGVTYPCVMGHETVGEVVEVGEDVTDVAVGDTCLAFPWIGCGECGKCAHGHENACDNGRALGIIQFGGFAEYLLLPDQRYAIDVAGVDPAWAATLACSGVTSYSSARKATATVNPDEPIGVMGVGGVGMMTVAALVALGHKNIIAIDVSDENLASAQELGATLTVNSKNATSHDLVEAAGGQFIAIIDLVNTGDTVALAFDALSRAGKIVQVGLFGGEFVVPTAIMALKGLTLQGNYVGTVEEVREVVELARQGSLPKLPITGGTLNVDGVNDGLERLRTGRARGRTVLTP

SEQ ID NO: 9936 - protein, 327 aa, Oryza sativa (japonica cultivar-group)
MAGDRRGGGGVVSADGERRRGIRRLLLPRGEGSSSSSPPQPPPLQAEEGRRKGFASAALRGLGCTSAAASQAYAPGAGAAAAAAVRSSADWHGRRRRRGKEKRKERGGGGGGGGGGHLVGGGIGADVWCAPGIPFAAEASSVDCVVARHQMVGRGRGGDAERPHRERPCLSRRVTVQEQISSSFMDSPPPPHLDVAPFFGADLLPSGRLRRMRGYRHSPVGLEEEIMMFQTRVLLGGMSMYDRYQDWRLDVDNMTYEELLELGDKIGYVNTGLREDEIVRNLRKEEFEANEEMGRLDCGHSYHVYCIKQWLSQKNVCPVCKTAVTKT

SEQ ID NO: 9937 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAADLTKRIQNAGTEVVEAKAGGGSATLSMGQAAARFGLSLVRALQGEKGVVECAYVEGDGQYARFFSQPLLLGKNGVEERRSVGTLSAFEQRSLEG

SEQ ID NO: 9938 - protein, 386 aa, Zea mays
  unsure (1)..(386): unsure at all Xaa locations
LRDTALKNIMNHIHYEDESTRYLCVCPVNKALNMICCWVENPNSDAFKRHLPRIYDYIWLAEDGMKLKVYDGTQAWDTAFIVKAYCSTDLVHEFSPTLRKAHEFIKSLQIPENQPDHENYYRHRSKGSWAHSTLDNGWSVSDSTAEAIQALLLLSKFSSNLVGDPIKEERLFDAVDCLLSFMNKDGTFSTYERKRTASFREMYPRYRDQEIKKCIKGASKFIESKQQKDGTWFGTWGVCYTYGTLFAVQGLVVAGRTYETVXIRKAGRFLLSKQLAPGGWGETYPSNGTAVYAEASSPHVVNTAWAMLALIYAGQVQRDPTPLYGAAKELINMQQESGEFPQQEHIGSFNCSFYFNYGNYRNLFPIWALGEFRRRIVAEKKRNQQT

SEQ ID NO: 9939 - protein, 496 aa, Burkholderia fungorum
MTNHPTAMPSLQEPSLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCMGGLAARPV

SEQ ID NO: 9940 - protein, 541 aa, Xanthomonas axonopodis pv. citri str. 306
MAAPAAKDYYGTLEPFAAEAVYFVVTDRFVNGDTGNDHRDQGGAHRTFDVPTPCADGSEDNIGYLGGDFKGIVEHADYIRDLGFGAVWITPIVDNPDEAFTGGKPITCGSTLSDHGKTGYHGYWGVNFYTLDEHLPSPGLDFAGFTRAMHASKLKVVLDIVGNHGSPAYTMPQAQPGFGKLYDAQGRLVADHQNLAPAQLDPQHNPLHAFYNTGGGLAELSDLNENNPAVLDYLAGAYLQWMEQGADAFRIDTIGWMPDRFWHAFVARIREKRPGFFMFGEAFDYDANKIAGHTWTRNAGVSVLDFPLKQQLAAVFGHEQAGFEKLAAPLFLRQGPYANPYALMSFYDNHDMARLDASDNGFIDAHNWLFTARGIPVIYYGSEIGFMRGRAEHAGNRNYFGVERIRTAPQSPIFGPLQRIAQVRRNTPALQRGVQVDVQLHGNQAAFLRVYQHAGTTQTALVLLNKADTAATIQVTRFLQPGAWRDAINGEQLQVQRGFATAVPAHGVRVLLSDAPITDPALRQQLDLQMAEQAARDARNR

SEQ ID NO: 9941 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCRYYTKSFRGSVDPFHVDAVDTTGAGDSFVGALLCKIVDDRAVLEDEARLREVLRLANACGAITTTKKGAIPALPTESEVQSLLKGN

SEQ ID NO: 9942 - protein, 748 aa, Bacteroides thetaiotaomicron VPI-5482
MSEVAPLISDLAIILIIAGIVTVIFKWLKQPVILGYIVAGIMAGPSVSLVPTVSDPANIKIWADIGVIFLLFAMGLDFSFKKLINVGITAIVATVTIVCGMMFIGYTAGNAMGFSHMSSIFLGGMLSMSSTAIVFKAFNDMGLLQQKFTGIVLGILVIEDLMAVVMMVVLSTLAVGKHFEGKEMLESILKLAAFLIFWSALGIYLIPTLLKKIRRFTSNEILLITSLGLCLGMVMIATKAGFSAALGAFVMGSLLAETVEAEKIVHIVQPVKDLFASIFFVSVGMMIDPAMMWEYAVPILILTLLVLSGQVLFGSFGVLLSGQPLKIAIQSGFSLTQVGEFAFIIASLGVSLNVTDKYLYPVIVAVSVITTFLTPYMIWLSEPAYRFIDIHMPESLKDYLVHYTSGAMTVKHQGTWHKLIRSMLVSVTLYLVVCVFFITLYFSYVHPLIRKSLPGMEGNLLGFIIIFLVISPFLWAIIMKRNNSTEFRKLWTDNKFNRGPLVSIVLVKILICTIIMMSIITHLFNVALGAGLVVSSIIIAVIYFSKRIKKRSLTIERQFMANFQGTDGNGLSTESDTGSTFGSNIPFKELHLADFTVSPDSIYVGRTLKESSLRTLFQINVISITRGEKRLDIPQGEEHLYPYDKVTVVGTDRQLESFRTSMEQKKVERNGNGTSSQDEMEIGQFPVEGGSPLIGKTIREADISDSIIIGIERSTVNIMNPDPDTIFKENDTVWIVGKRKIIKGLNKD

SEQ ID NO: 9943 - protein, 388 aa, Rhodospirillum rubrum
MTAIERLPLDRALGRVLAEDLTSALVIPPDDNSAMDGYGVRFADLSPQAPTRLPLTLRVPAGHPADRPLGPGEAARIFTGAPIPEGVDTVIMQEVCHEEDGYVTLPSGEKRGANVRPAGADVAIGQTVLASGRRLGPIDVAMAAQIGVAELAVRARLKVAVFTTGDEVVEPGQPLPPGGIYNSNRRALLGLLSTLGAECLDLGNLPDRPALIQGALAEAARAADLVVTSGGVSVGGEDHVKDAVTALGSLAFWRLALKPGKPLAFGTVAGKPFLGLPGNPVSTFVTFCLVGRPVVLRLAGVTGEQLQPRGFPVIADFSLTRKPGRREFLRGQLRSDSSGAMVVAPFPVQSSNVVSSIVQSDGLIDIGQGVTVVSRGDRVRFIPFSELF

SEQ ID NO: 9944 - protein, 469 aa, Streptomyces roseosporus
MFQNADEVQKYVADNDVKFIDVRFCDLPGVMQHFTIPAATFDPAEELAFDGSSIRGFQAIHESDMALRADLSTARVDPFRRDKTININFFIHDPITGEQYSRDPRNIAKKAEAYLASTGIADTAYFGPEAEFYVFDNVRFQTSANESFYHIDSEAGAWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWQGGSPLFYDEQGYAGLSDTARYYIGGILKHAPSLLAFTNPTVNSYHRLVPGFEAPVNMVYSQRNRSAAMRIPITGSNPKAKRVEFRAPDPSSNPYLAFSALLMAGLDGVKNKIEPAEPIDKDLYELAPEEHANVQQVPTSLPAVLDALEADNEYLQAGGVFTSDLIETWIDYKRTNEIAPIQLRPHPHEFELYFDI

SEQ ID NO: 9945 - protein, 376 aa, Zea mays
ALILSGGCRGVQRDQAKAILSTQAVRIATKAEQHERFIFKVTHLLGVLGFGGFCYLLGARPQDVPYVYCLFYVIFVPLRWIYYRYKKWHYYLLDFCYYANTFLLVMILFYPEDEKLFMVCFSFAEGPLAWALIVWRCSLVFSSFDKLVSVLIHLLPGIVLFTIRWWNPQTFAAMHPEGRDARVTWPYVEDKSYLWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQVVQKQLKKLDMKPMEQGSSTQGAPGGDGGTLGNHPPAHIRGAYPGVRKLKLDVRLDFDVH

SEQ ID NO: 9946 - protein, 494 aa, Zea mays
LGQQLRVLHALDVARTQLYHFMATAIAGMGFFTDAYDFFAISLVMDLISYLYYEEQIDRGVKATINGIALCGAVPGQLVFGWLGDKMGRKRIYGVTLLLMVVTSLASGLYFGTNEASNVVAVLCFFRFWLGFGIGGDYPLSATIMSEYANKRRRGAFIAAVFAMQGFGNLAAGIVAVVVSASFLKTNPRRNANFVWRIVLMLGAVPAIFTYYWRMKMPETARYTALVAKDARKAASEMSSVLNMEIGQEDEAVRELVRQDEYGLFSVQFLRCHGTHLLATSVCWLAVDITFYSLNLYMKDIFVDVGLIDPPEKSDLFKRMTVSTLLHMAIAFGGTLPGYFFTVAFVDRIGRVRIQLLGFTMMAALTASLAATYDPYWKQQKTKRRKIGFAVLYGLTNFFTNFGPNTTTFIVPAEIFPTRMRATCHGIAGAFGKIGAIIGVFGFMFTMEEHHVAPRALWALFASNLVGLVFTFLLPDSKGKSLEEMTGETEEQQG

SEQ ID NO: 9947 - protein, 564 aa, Saccharomyces kluyveri
MSEITLGRYLFERLKQVQVQTIFGLPGDFNLSLLDKIYEVPGLRWAGNANELNAAYAADGYARVKGMSCIVTTFGVGELSALNGIAGSYAEHVGVLHVVGVPSVSSQAQQLLLHHTLGNGDFTVFHRMSSEISETTAVITDIKDAPKEIDRCIKVTYSKQRPVYLGLPANLVDLKVSASLLDTPIDLSMTPNDADAEDEVVETVLAMVSKAKNPVILADACCTRHDVKRETKKLIDLTQFPAFVTPMGKGSIDEDHPRFGGVYVGTLSDPEVKEAVESADLVLSVGALLSDFNTGSFSYSYKTKNIVEFHSDYTKVRNATFPGVQMKLVLQKLLSKVSDAASGYKPVPVPKGTRSNPGVESSTPLKQEWIWNHISDWLEEGDVVITETGTSAFGINQSRFPNSTYGISQVLWGSIGYSVGSCLGAAFAAEELDKNRRVILFVGDGSLQLTVQEISTMVRWGLKPYLFVLNNDGYTIERLIHGETAQYNDVQPWLHLNLLPTFGAKDYDSIRISTTGEFLKLTEDQAFSRNSKIRLIEVMLPVMDAPSTLVKQAQLTAATNAKQG

SEQ ID NO: 9948 - protein, 213 aa, Streptomyces halstedii
MEAGRGAPAAVRAVTVCVARGDPAMELTLVVLIIVVGLVFDFTNGFHDAANAIATSISTRALTPRIALGMAAVTNFAGAFLGTEVAKTVGSGIIGAPEDLSGLLLVMCALLGAIGWNVFTWWRGLPTSSSHALIGGLVGAALAASATVHWSGIVDKVLLPMLLSPLVGVALGYTLHAAVLWTFRHAAPRPLTRRFRLAQTVSAAAMGLGHGLQ

SEQ ID NO: 9949 - protein, 488 aa, Rosenvingea intricata
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVIVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIIMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAASCGPLKAALDLWKDITFDYTSTDTPDFVEVATGSR

SEQ ID NO: 9950 - protein, 475 aa, Pterocladiella beachii
ERYESGVIPYAKMGYWDPDYTVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIASTGEIKGHYMNVTAATMEDMYERAEFAKQLGTVIIMIDLVIGYTAIQTMAIWARKNDMILHLHRAGNSTYSRQKSHGMNFRVICKWMRMAGVDHIHAGTVVGKLEGDPLMIRGFYNTLLLPYLDVNLPQGIFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 9951 - protein, 595 aa, Pseudomonas putida KT2440
MPHEGSLLQTAVIFLLAAVLAVPLAKRLQLGAVLGYLLAGVVIGPQALGLIRDTESVAHISELGVVLLLFIIGLELSPKRLWLMRKSVFGVGTAQVVLTGAVIGAIALFGFSQTLPAAIVLGLGLALSSTALGLQSLAESKQLNAPHGRLAFAILLFQDIAAIPLIALVPLLAASGPDTSQGDSLQHGLKVFASIAVVIIGGRYLLRPVFRTVARTGLPEVSTATALLVVIGTAWLMEEAGISMALGAFLAGLLLADSEYRHELESQIEPFKGLLLGLFFISVGMGANLRLLLEMPLVVLGLTLLLVAVKLLLLIGVGRLVGGLNSASALRLGMVLAAGGEFAFVVFKLGKDQGLFDTQTYDLLLMTITLSMAITPLLMLGCARALKRPQPAREVPEQYKQIQTDTPRVVIVGMGRMGQIVARILRAQKIPFIALETSVDTIEMTRMFEQVPVFYGDPLRPEVLHAAKVGEAEYFIITIDDPEAAIHTAARVKRLYPHLKVLARARNRQHVHKLADVGAEPIRETFYSSLEMTRRALVGLGLSDEQAADRIARFTQHDEEVLEAQGQVRDDRAKVMQTAKEARVELERLFDSDAD

SEQ ID NO: 9952 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 9953 - protein, 187 aa, Zea mays
PPPPFFPLPPRLHPFPSISSHLATPLPLSRADRLAHPSIEHGKKIPVRRGLNSIGLVLVWVGTMAATEASADKNAVFRKLRTKSDNKMCFDCNAKNPTWASVTYGVFLCIDCSAVHRSLGVHVSFVRSPRLASPHLTCFPFLLTLVHVRGTVAMPPVHDSNTNLLQWLTDRSRVHISNINLLQLVTD

SEQ ID NO: 9954 - protein, 543 aa, ASPERGILLUS NIDULANS FGSC A4
MVAADDTIPELAEGHMEPPVPESRVLIIMTGGTICMRPSPAGLVPARDFQKQCLARVPTFNDGSNSTMMDVVTNAVGEIKAHVSLRTPLTAYGRRVRYTVFEFDELLDSSSIDAKGWSEIARTIERNYTLFDGFVVLHGTDSLAYTCSALSFMLQNLGKPVILTGAQAPMLELQNDATDNLLGSLVVAGHFMIPEVAASDFNAFNSPNCAPLAVTTSMRTNVNWEIVNRPNSIEHFSIQTNLDTTHVACLRIFPGIKPEMVDAVLKLEGLRGLVLETFGAGNAPHGQDNAMTKVLADAIARGIVIVNVTQCLTGSVSPVYAPGMSLSKAGVVAGLDMTTEAALTKLAYLLALPGADPKLVASKMSVSLRGELTESSQPVFRHPDGALPERVQALTILGYAIAQGDLARVEELLKSEHHWLLNDADYSGNTPMHLAATSPSVDILRFLLLQGGSVHLRNRNGRTPLFLAANAGLSEHVLLLRKSGAHLHSDERTAAQLLARRRPGIWGLAGIGPREISDREMEEVDGDGYRAGSSHWPMAGSAP

SEQ ID NO: 9955 - protein, 445 aa, Phyllophora crispa
FRITPQPGVDPVEASAAVAGESSTATWTVVWTDLLTACDLYRAKAYKVVAVPNTSDQYFAYISYDIDLFEEGSIANLTASIIGNVFGFKAVKALRLEDMRLPVAYLKTFQGPATGIIVERERMDKFGRPFLGATVKPKLGLSGKNYGRVVYEGLKGGLDFLKDDENINSQPFMRWKERYLYAMEGVNRSIAASGEVKGHYLNVTSATMEQMYERAEFGKQLGSIIIMVDLVIGYTAIQTMAIWARKNDMILHLHRAGNSTYSRQKDHGMNFRVICKWMRMAGVDHIHAGTVVGKLEGDPLMIRGFYNTLLLPYLQVNLPQGIFFEQDWASLRKVTPVASGGIHCGQMHQLLDYLGIDVVLQFGGGTIGHPDGIQAGATANCVALESMVMARNEGRDYVAEGPQILQDTAKTCGPLQTALDLWKDITFNYTSTDTADFVETPTANV

SEQ ID NO: 9956 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSA

SEQ ID NO: 9957 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 9958 - protein, 826 aa, Zea mays
  unsure (1)..(826): unsure at all Xaa locations
INNCVLFQCRYIRAFFVYGGCNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPGRCPVGRSGNIRTWPAHQGITMVLHHSSSTQMMVPSAISSATAHRLSSICHLFSSSSLLXYCLGLVTYGVAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDXRNHVILQTRKMRTWISLMRRWTCMWISTRSQIHHLTQWLRPCHWQKHQSFFQCPPGHYNRLGPLFFNTNDDAIRNLFSNGTSTEFQMSSLFIFFTAIYCLGLVTYGIAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 9959 - protein, 448 aa, Triticum aestivum
  unsure (1)..(448): unsure at all Xaa locations
HASGLMAFSMGETRVVVTADPDVARELLASPAFAXPAXVRXSAYGLMFHRAIGFAPYGAYWRTLRRVSSSHLFSPRQVAASAAQRALIAHASADAWGPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGSGGVDLSEVLRLSCEMAAPLEARLRPRRAV

SEQ ID NO: 9960 - protein, 130 aa, Glycine max
  unsure (1)..(130): unsure at all Xaa locations
MAPAVMASSATTVXAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQV

SEQ ID NO: 9961 - protein, 472 aa, ASPERGILLUS NIDULANS FGSC A4
MSSPEYDPSIPDGGDTTKLDVNAPFVGYEFHAVYIAACTFIVYLILPGIGFLYSGLTRRKSAMTFLFQAFLVLAVTTFQWMFWGYSLTYSRDGGPYIGTLQNFGLMDALAAPSPGSAVLPEVLFCLYQLLFGSCTVMIVVGGAFERGGILASLVFAFVWETIVYCPLARWTWSSHGWLYNLPSVDFAGGGPVHIASGCAALAYAVVLGKRKGYPDASMKRPHNTTLVFLGTVFIWTGWLGFNGGSTLNASVRSYMAVMNTNIAGSTGVLGWVLVDMIRNKGKFSMVGACEGAIAGLVGITPCAGCVTFWLGALVGFLTGIVCSACKNLNEWIRVDEGMDVFKLHGVGGMVGSFLTGIFADQYISALDGDSLIPGAINGEGVQVGKQLAEICAISAYSFGVTWVILMVMKFIPYLGLRANEEAEMVGLDRSFFVDEQIGDYSMLDGINSSPLMGVSKTPSSEVQQTAAETKRA

SEQ ID NO: 9962 - protein, 360 aa, Streptomyces avermitilis MA-4680
MTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 9963 - protein, 451 aa, Oryza sativa
MEAEKKPPAVSDVGAWAMNVVSSVGIIMANKQLMSSSGYAFSFGTLRAFARSSSSPFPSPQIWIRRFGFVPATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFADYYLNGRWLLNYNFSTGATFFILLSCSLAVFCNMSQYLCIGRFSATSFQVLGHMKTVCVLILGWILFDSALTVKNILGMLLAVMGMVVYSWAVETEKKASAPIPRNKSDMLDDSEDVPLKARDDSVEAVDIFFLLFCLRFGYLSACAAMVVVSFAMSAMRIGIVHFVGVACLTWEMWHVAKAGNEDVDGGRLPAQRGKATANDGNTTFLSFSACDV

SEQ ID NO: 9964 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 9965 - protein, 247 aa, Streptomyces clavuligerus
MPSALQGKVALITGRELGHRRATARALAPEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVTVRNAAVYQATKFGVNAFSETVRQEVTERGVRVVVIEPGTTDTELRGHITHTATKEMYEQRISQIRKLQAQDIAEAVRYAVTAPHHATVHEIFIRPTDQV

SEQ ID NO: 9966 - protein, 412 aa, Pyrococcus furiosus DSM 3638
MQLGFAMLADPILLITILLGFAMAWAIGANDAANSMSTAVGAGAITPRQAVIIAGVLEFMGAYFFGKTVTETIRKGIIDPSKITDPNVLIFGSIAALIGATIWLVIATKYGLPVSTTHSIIGGIVGYGIVYGGMSIVNWDKMIKVVLSWILSPIVGAIFAYLVFRALSKTVLQSKDPVKSAKRWSPFWIGLAFVVIGTMFYIKVLHGNSLLEGFLKYGMPAGILTFIVVSLILEKRFPATDPYLGAERVFRRVQVITSAYVALAHGANDVANAIGPVAAVYTVAMFGLAGAKVPVPRWILALGGLGIAIGVATYGYKVMETVGKKITELTNTRGFTIDFSAATVVLIASWLGMPISTTHTVVGAVIGVGLARGIKAINKDIVKDIIISWFVTVPAAGVIAGIIFKALMMLMG

SEQ ID NO: 9967 - protein, 543 aa, Gossypium hirsutum
MVAPQLAAVFTKLQTLSTSDHASVVSMNIFVALLCACIVIGHLLEENRWMNESITALIIGVFTGVIILLTSGGKSSHLLVFSEDLFFIYLLPPIIFNAGFQVKKKQFFRNFITIMLFGAVGTLISCTIISLGVINFFKEMDIGSLDIGDFLAIGAIFAATDSVCTLQVLNQDETPLLYSLVFGEGVVNDATSVVLFNAIQSFDLVNTSPRILLEFIGSFLYLFLASTMLGVIVGLVSAYIIKKLYFGRHSTDREFALMMLMAYLSYIMAELFYLSGILTVFFCGIVMSHYTWHNVTESSRVTTKHAFATLSFVAETFLFLYVGMDALDMEKWRFVSDSPGTSVAVSAVLMGLVMVGRAAFVFPLSFLSNLAKKSTSEKISFREQIIIWWAGLMRGAVSMALAYNQFTRGGHTQLRGNAIMITSTITIVLFSTVVFGLMTKPLIRFLLPHPKPTASMLSDQSTPKSMEAPFLGSGQDSFDDSLIGVHRPNSIRALLTTPAHTVHYYWRKFDNAFMRPMFGGRGFVPFVPGSPTERSEPNLPQWQ

SEQ ID NO: 9968 - protein, 358 aa, Medicago sativa
MGSIEAAERTTVGLAAKDPSGILTPYTYTLRNTGPDDVYIKIHYCGVCHSDLHQIKNDLGMSNYPMVPGHEVVGEVLEVGSNVTRFKVGEIVGVGLLVGCCKSCRACDSEIEQYCNKKIWSYNDVYTDGKITQGGFAESTVVEQKFVVKIPEGLAPEQVAPLLCAGVTVYSPLSHFGLKTPGLRGGILGLGGVGHMGVKVAKALGHHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWKEKGLTSMIEIVTMDYINKAFERLEKNDVRYRFVVDVKGSKFEE

SEQ ID NO: 9969 - protein, 193 aa, Zea mays
  unsure (1)..(193): unsure at all Xaa locations
ITMDPTKFRPSSSHDTTVTTTNAGAPVGNDNEVLTVGPRGPILLEDYHLIDKVAHFARERIPERVVHARXGACGKGFFRGPHHVTSLRGPNFLGAPGXTPRIRPSQKESQKGAPRKIPPPGGFPRKFPPRGGNGHRVKKNSPVFYPRGVKSPRGNTPFKTPPRKKEKKTGGGFHFCAPPPREGPLFSFFPGGG

SEQ ID NO: 9970 - protein, 447 aa, Zea mays
  unsure (1)..(447): unsure at all Xaa locations
MGQGSPGGMGKQPGLPGDRKQGDGKKEKKYEPPAAPSRVGRKQKRQKGSEAAARLPAVAPLSKCRXFALLKLERVKDYLLMEEEFVASQERLRPSEDKTEEDRSKVDDLRGTPMNVGSLEEIIDETHAIVSSSVGPEYYVGILSFVDKDQLEPGCAILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDVKTRRRIFQIHTSKMTLADDVNLEEFIMSKDEFSGADIKAICTEAGLLALRERRMKVTHADFKKAKEKVMFKKKEGVPEGLYM

SEQ ID NO: 9971 - protein, 478 aa, Gracilaria cornea
IKNERYESGVIPYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLEVNLPQGIFFEQDWASLRKVTPVASGGIHCGQMHQLLDYLGNDVVLQFGGGTIGHPDGIQAGATANRVALEAMVIARNECRDYVAEGPQILRDAAKTCGPLQTALDLWKDISFNYTSTDTADFVETPTANV

SEQ ID NO: 9972 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHVGGGWEGGDQQNIAYGHPQAHSQGLYQSLECDPTLQIGYSHPVCSEQMAVTVQGQSQQGNGYIPGWML

SEQ ID NO: 9973 - protein, 294 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPAEDHVVVINVGKADKSSCAEVRPVTEMASAVDVPRRCAAEAAAPGQQVMAVDFARSVEVV

SEQ ID NO: 9974 - protein, 579 aa, GIBBERELLA ZEAE PH-1
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITVFWLFIIFINVFGTLGYAEEEFWSSCFKLAAIIIFMIVAVVLICGGGPSRGNFSTYQGAKLWYDPGAFQNGSRGFCAVFVTAAFSFAGTELVGLAAAESRNPAKALPGAIKQVFWRITLFYIVGLTLVGMLVSSTDDRLLNSANPYKDGVSPFVLAALDAGLNGYDDFMNLVICVSVVSIGVSCVYGGSRTLTALAEQDYAPKCFTYIDRSGRPLMSVIFNLAWGALAYIVLASSGGLVFDWLLAVSALAALFTWGSICACHIRFRSAWKRQGRTLDQIPFHAAGGVYGSWLGLTLCFVILGCQLYVAVCPPFKEGYGNAEDFFMACLAIPVVLVFWIIGYIWKRPQWLTIDKIDLDTGLREHDWDEINAYRAKVASWPAWRRALNKFM

SEQ ID NO: 9975 - protein, 143 aa, Triticum aestivum
  unsure (1)..(143): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGRYWTMXGKLPMFGCTDATKXTKVEEVKEGVPDA

SEQ ID NO: 9976 - protein, 197 aa, Syrrhopodon trachyphyllus
GGAKKVVISAPSKDAPMFVMGVNEEKYASEDIVSNASCTTNCLAPLAKVINDKFGILEGLMTTVHATTATQKTVDGPSNKDWRGGRSAATNIIPSATGAAKAVGKVLPELNGKLTGMAFRVPTTDVSVVDLTVRLQKPASYDTIKAALKDASEGKLKGILGYTEDDVVSSDFITDSRSSIVDAKAGIALSDTFVELV

SEQ ID NO: 9977 - protein, 345 aa, Glycine max
MAHPTSSGQSNDLTKEDCKETSSVVVCFGEMLIDFVPMVGGVSLAEAPAFKKAPGGAPANVAVGISRLGSSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 9978 - protein, 268 aa, Triticum aestivum
  unsure (1)..(268): unsure at all Xaa locations
GSGTRDRPGRRRRPWXPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLXSXDGKAHLVKFHWKPTXGVKCLLXDETXTVGGTCXTMPQXT

SEQ ID NO: 9979 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWVPKAGI

SEQ ID NO: 9980 - protein, 374 aa, Photobacterium profundum
MKMKSLYIHGQATDVSSGETFITSNPATGEPLAEIGQASAQDVDRAIASAQAGFKVWSAMSGIERGRILMRAVAILRERNDELAELEVKDTGKPIQEAIEVDIVTGTDVIEYYAGLAAAIQGQQQDLGHGQFFYTRREPLGVCAGIGAWNYPIQIAMWKSAPALAAGNAMVFKPSEETPLSVLKLAEIFTEAGVPDGVFNVVQGDYRVGQMLSRHPDIAKISFTGESGTGKKVMADAAGTLKDITMELGGKSPLIVFDDAKLDNAVSAAMLANFYTQGEVCTNGTRVFVHDAIYDDFIEQLAHRTNKLVIGDPADMSTQIGALISGEHLEKVLGFIQAGKESGARLICGGERENWQRTRQGVLCSTDHFCRLYR

SEQ ID NO: 9981 - protein, 453 aa, Chondracanthus tepidus
  unsure (1)..(453): unsure at all Xaa locations
KDTXVLALFRVSPHPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRSIAAAGETKGHYLNVTAATXXXXXXXXEFAKELVYIIMMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQTGATANRVALESMVIARNEGRDYVSKGPQILQDAPKTCGTLQTALDLWKDITFNYTSTDTXXXXXXXXXNV

SEQ ID NO: 9982 - protein, 589 aa, Neurospora crassa
MGTHDSISSVQPDLEQPSHAGGHGSNGIDELDESRLAQFGYKQELNRDWGLAHNFGVSFSIISVITGLTTLFSYGLATGGPAVMSISWIVISFFTLLVAIAMAEIVSAIPTSGGPYFWSAMLAPPRWSPFLAWLTGWFNLLGQVAVTTGITFGLAGLVSTAITVKNPDYEPTAAKTIGIYAALLVSHGVVNTFGVKGLRFLNNVSIVLHSAGITALCIAVLAKAPKLQSAKFVFGTYHDGTAAEEGTEGWGQRASPAYVVLCGALLSQYTLTGFDASAHLSEETKNASWSAPIGVVSSVGFSSLFGFFVLMAFLFSIQDFESTLNSKYGQPVLQILVDVAGEDGALVLFSLIMLCVWHCGLFSMTSNSRMMFSFARDRGIPSFFHQVDDRFKSPIRAVWLAAILSFILALPSLGSDVAFAAATSIATIGLYLSYGLPIMIGFFWHKNFTAMKGPFNLGALSRVIAGAACLWICFITVVFCLPTANPVTSQTLNYTVVAVGIIAVGSIGSWVVWARRWFTGPAAEVAEAMRLGVDITEPGALEKKEKEALEGARMEGEREAREREEKQPPAVTLIEQAPVPNMDEHEETV

SEQ ID NO: 9983 - protein, 318 aa, Oryza sativa
MAALSSRRRHGSLRLLAVALLAKDKLEKSMVADNESGKSVMSEVRTSSGMFLEKKQVVFFCSLREMKFDQLFPIYISIVCKALNHVVIFAIWTSILSNRPVLKLDEVVARIEERIAAWTFLPPDNGESIQILHYQNGEKYEPHYDYFHDKNNQALGGHRIATVLMYLSDVGKGGETIFPEAEGKLLQPKDDTWSDCAKNGYAVKPVKGDALLFFSLHPDATTDSDSLHGSCPVIEGQKWSATKWIHVRSFDISVKQGASTDGCEDENVLCPQWAAVGECAKNPNYMVGTNEAPGFCRKSCNVCAHCRIEWNTYALAYV

SEQ ID NO: 9984 - protein, 139 aa, Triticum aestivum
DASGRENEPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGQFMADGMYSLGS

SEQ ID NO: 9985 - protein, 250 aa, Arabidopsis thaliana
MSRRYDSRTTIFSPEGRLYQVEYVMEAIGNAGSAIGILSKDGVVLIGEKKVTSKLLQTSTSAEKMYKIDDHVACAVAGIMSDANILINTARVQAQRYTFMYQEPMPVEQLVQSLCDTKQGYTQFGGLRPFGVSFLFAGWDKHHGFQLYMSDPSGNYGGWKAAAVGANNQAAQSILKQDYKDDATREEAVELALKVLTKTMDSTSLTSEKLELAEVYLTPSKTVKYHVHSPESLTKLLVKHGVTQPAAETS

SEQ ID NO: 9986 - protein, 723 aa, Xanthomonas campestris pv. campestris str. ATCC 33913
MAADRIDSLIARMTVEEKVGQLGVFADMVRPFAPDVNPEANVLNADEVLQQVRQGRVGSLFNGVGAALGVQIQKVAVEESRLGIPVILAADVIHGMRTVFPIPLGEAASFEPELAERTARATAIEATAAGLHWTYAPAVDIARDQRWGRGAEGAGEDVVLGMAFAAARVRGFQGSDLKADDCLLATPKHFAAYGAVAAGMEYNTVDIAPQTLRDVHLPPFKAAFDAGALTVMSSFNDINGVPASANHELLTEILRGEWQFPGVVISDYTADMELIAHGYAADERDATKKAFLAGLDLSMQSGFYAAHLPSLVESGEVPMATLDASVRRILQLKEAIGLFDNPYRSLDPAREADTAHLPAHDALSRDAARRSIVLLKNEGDLLPLKKSGQNIALIGPFVQDRENIEGCWTLFGDKERYVTLEQGVRAVVAADNLSVVAGCGLEEPLPGGISAAIDAAQAADVVVLALGEPQRFSGEAQSRTEITLPPAQQALAEAVAATGTPMVILLRNGRALALSGAVRDADAIAVTWYLGTQTGTGVADVLFGDYNPSARLPISFPQVTGQQPYFYNHLRTGRPELPTLSEYKARWREMPNEPLYPFGHGLSYTTFAYAAPQLSTTQLGWEQTLTITTRVTNTGTVAGEEVVQLYVHDRVASRVRPVRELKGFRKVLLQPGESAEVVFTLQRDALAFTNHKGVFGAEPGLFDVWVCASAKSGEPVSFELLDR

SEQ ID NO: 9987 - protein, 444 aa, Oryza sativa (japonica cultivar-group); identical to SEQ ID NO: 9891

SEQ ID NO: 9988 - protein, 306 aa, SYNECHOCOCCUS SP. WH 8102
MIDRLGPPGGDPAIDGPLDDRLGGAPANVACGLARLGTSVAFLGRLGADAIGDRFATLFLQRGVDVDSVQWDAQRPSRIVLVRRSADGERQFRGFAGDEGLGFADQALASVELPKQARWLLTGTLPLAAHASADSLRGAVAQSKARGIALAVDVNWRPTFWDSAARPDAGPSQQAIELIRPLLEQAALIKLAREEAIWLFGSTDPRAICTQLPQEPDVVVTDGAEPVRWWMDGASGTQPAFHPPQVVDTTGAGDAFTAGLLHRWSASPAERVRFASACGALVCAGAGGIDPQPTEAQVEAFLGGVS

SEQ ID NO: 9989 - protein, 107 aa, Zea mays
  unsure (1)..(107): unsure at all Xaa locations
LALGTDKLRVHQVVXPVPHDSSTNEIGVTLDTRPFTQCQPMFEDXQVDVDTRVMLHRGQEERRVCLRMVETYPVNMYVNDLSRDERETDDHLVSLEIRTLMGHQDLA

SEQ ID NO: 9990 - protein, 290 aa, GIBBERELLA ZEAE PH-1
MEGIQTHPSNAAQAKAFTAPGSLSFPGATNELTPPPVGNGDATQQPPHNGQQAANGNGVAPATPVATPAATQGPSGITPTLQNIVATVNLDCRLDLKTIALHARNAEYNPKVHQTLRRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMIKPKIVLLIFVSGKIVLTGAKVREEIYQAFEMIYPVLQGLRCHHIISYPTHHIITILSTCMIRHKPSRYHDCF

SEQ ID NO: 9991 - protein, 595 aa, Oryza sativa (japonica cultivar-group); identical to SEQ ID NO: 4552

SEQ ID NO: 9992 - protein, 370 aa, Brucella suis 1330
MASRKLLLLPGDGIGPEAMAEVRKVIAFLNSDLNLGFETEEGLVGGCAYDAHGQAISDADMEKALAADAVLFGAVGGPKWDSVPYEVRPEAGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQVVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 9993 - protein, 400 aa, Bacillus cereus ATCC 14579
MMTYTLATRMKAFQSSIFSELGAYKKEKIAAGHNMIDLSIGNPDMPPADFVRETMVHTASEKESYGYTLSGIQEFHEAVTEYYNNTHNVLLNADKEVLLLMGSQDGLVHLPMVYANPGDIILVPDPGYTAYETGIQMAGAISYYMPLKKENDFLPDLEVIPEEIADLAKMMILNFPGNPVPAMAHEDFFKEVIAFAKKHNIIVVHDFAYAEFYFDGNKPISFLSVPGAKEVGVEINSLSKSYSLAGSRIGYMIGNEEIVRALTQFKSNTDYGVFLPIQKAACAALRNGATFCEKNREIYQERRDTLIDGFRTFGWNVDKPAGSMFVWAEIPQGWTSLDFAYALMDRANVVVTPGHAFGPHGEGFVRIALVQDKEVLQQVVENIRNSGIFVLEKVNELVKN

SEQ ID NO: 9994 - protein, 337 aa, Omphalotus olearius
MVVKVGINGFGRIGRLVIRNALEAQGVEVVAVNDPFIPLDYMVYMFKFDSVHGRYKGTVEAKDGKLIIAGKPIAVFGERDPASIPWGASGADYVVESTGVFTTIDKASAHLKGGAKKVIISAPSADAPMYVCGVNLDAYDPRRPSISNASCTTNCLAPLAKVIHDKFGIVEGLMSTIHATTATQKTVDGPSNKDWRGGRSVNNNIIPSSTGAAKAVGKVIPSLNGKLTGLSFRVPTLDVSVVDLVVRLEKEATYDEIKAAVKEAVAGPLKGILDYTEDALVSTDFTGNTHSSIFDASAGIALNKNFVKLIAWYDNEWGYSRRVVDLITFVAQKDGNA

SEQ ID NO: 9995 - protein, 537 aa, Neurospora crassa
MYKIGNIYFIAAVAVIGGALFGFDISSMSAIISTQPYLCQFNQLGHNEKGLCLGPTNDVQGGITAAMPGGSWLGALCSGFVSDTFGRKRSIQIGSVIWIIGSVIVCASVNIPMLVVGRIINGFSVGICSAQVPVYISEIALPSKRGRLVGFQQWAITWGILIMFFICYGCSFMKGTAAFRVPWGLQAIPAALLFLGLVFLPESPRWLCKKDRWDEAKDVLTLVHGKGNPNSPWVHREMQEIREMVEFERANADVSYFELFKPNMINRTSIGVFTQIWSQLTGMNVMMYYITYVFTMAGLADGSENAVLLPSGIQFVINVVMTIPALLWMDRWGRRPTLLVGAFFMCLWLCVNAGLFAVYSRPARPGEFTSPAESMAITGAPAKAVIASTYLFVASFAPTWGPVSWTYPPELYPLRLRGKAVALCTSANWAFNFALAYFVPPAFANITWKTYVIFATFCAAMFIHVFFMFPETANKPLEEVEEIFDDTKPGAIKYIGTPAWKTRNTRNLTLKQEHNDTLSSEEKIGLEEHAHKETTGR

SEQ ID NO: 9996 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVEQLPVKILLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 9997 - protein, 369 aa, Geobacillus stearothermophilus
MGVKTFQFPFAEQLEKVAEQFPTFQILNEEGEVVNEEAMPELSDEQLKELMRRMVYTRILDQRSISLNRQGRLGFYAPTAGQEASQIASHFALEKEDFILPGYRDVPQIIWHGLPLYQAFLFSRGHFHGNQIPEGVNVLPPQIIIGAQYIQAAGVALGLKMRGKKAVAITYTGDGGTSQGDFYEGINFAGAFKAPAIFVVQNNRFAISTPVEKQTVAKTLAQKAVAAGIPGIQVDGMDPLAVYAAVKAARERAINGEGPTLIETLCFRYGPHTMSGDDPTRYRSKELENEWAKKDPLVRFRKFLEAKGLWSEEEENNVIEQAKEEIKEAIKKADETPKQKVTDLISIMFEELPFNLKEQYEIYKEKESK

SEQ ID NO: 9998 - protein, 609 aa, Saccharomyces pastorianus
MPLSEDFGSSGKKETSPDSISVRSFSAGNNLQSLTSEKSYSRDSTGNDKLIHRFVDSFKRAESSTTKTKQINKNTSDLEEDVHSFTSDSDLKKSMKSRHVVMMSLGTGIGTGLLVANAKGLHYGGPAALVIGYVLVSFVTYFMIQAAGEMAVTYPTLPANFNAYSSIFVSKPFGFATVWLYCFQWLTVLPLELITASMTVQFWNDKINADIFILIFFVFLLFVHFFGVKAYGETEFIFNCCKILMIAGFIILSVVINCGGAGNDGYIGGKYWRNPGAFAGDSSASRFKNICYILVTAYFSFGGMELFALSVQEQENPRKSTPVAAKRSIYRILIIYLLTMILIGFNVPYNDDQLMGSGGSATHASPYVLAASIHGVKVVPHIINAVILISVISVSNSSLYAGPRLMCSLAQQGYAPKFLDYIDREGRPLRALIVCSIFGTVAFVAASSKEEVVFTWLAAIAGLSELFTWTSIMLSHFRFRQAMKVQGRSLDELGYKATSGIWGSAYGVFFNILVFIAQFWVALAPLGNGGKCSVESFFESYLAAPIWLAFYLGYMIYNRDFTFLNPLDKIDLDFHRRVYDPELMRQEDLENKEKKKHMPLMKKAYLFWC

SEQ ID NO: 9999 - protein, 458 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDGVHGSYIGVKGEAIYIPPPPCVPIDTCGAGDAYASGILYGILRGSSDLKSIGLLASRVAAIVVAQQGTRLRVQDADRLAESFTLHLDNLEFCSDIETDHVSNF

SEQ ID NO: 10000 - protein, 93 aa, Zea mays
  unsure (1)..(93): unsure at all Xaa locations
SFMVASPNSNYTETEIHIDHNYKSTELLHEIHNGTYQXVDNPNTVKYEYNTNTHVPKLXLILMAWRGNNVSTLTVDVIANRDDISWASNVKIQ

SEQ ID NO: 10001 - protein, 315 aa, Clostridium perfringens str. 13
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELKDKKNLDLNSWREIISYGNKVGALTCTNYGAIDAIPNEEDLMKYI

SEQ ID NO: 10002 - protein, 338 aa, Burkholderia fungorum
MTTVTRSFDDAWRRWIAENLLLDAPPSALHGALLGHGFDAADVTREIEAALASPYFHGAARLRNRLRKREWILSVYSELNRMRAASGVIERCERLSRDAFFEQYYFQNRPVIITGAFDFWPACSRWNWDYLRRQCGDCEVEVQFGRESDANYEINQPRLTRMMRFADYVDLVEQRGPTNDFYMTANNTSRNRAALAALWSDVPPIDAYLDAASPDTGFFWMGPAGTKTPFHHDLTNNFMAQVIGRKHIKLVPLSDTPYMANHLHCYSRVDGGAIDFDSFPSMRQAQLIECTLAPGELLFLPVGWWHYVEGIDASVTMTFTNFLRSNDFSRRYDTYHEL

SEQ ID NO: 10003 - protein, 939 aa, Arabidopsis thaliana
MIKTKKVILSCWLQLKTCWFWQKLAKTTSKEFWLQCEGIVQDLDDRRQELPPGVLKQLHTRMLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKFDALIVETFGTRIEKLIQEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVRFFYSFTCSENLYLVMEYLNGGDFYSMLRKIGCLDEANARVYIAEVVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEVKQHSFFKDIDWNTLAQQKAAFVPDSENAFDTSYFQSRYSWNYSGERCFPTNENKDSSEGDSLCGSSGRLSNHHDEGVDIPCGPAEFETSVSENYPFDNFSFKNLSQLAYINYNLMSKGHKDETQPSLQRR

SEQ ID NO: 10004 - protein, 368 aa, Clostridium perfringens str. 13
MNNCIGIINLDENESKIGELAKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESNISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDEKIVGLEYCPMVLSKPNII

SEQ ID NO: 10005 - protein, 299 aa, Corynebacterium glutamicum ATCC 13032
MPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 10006 - protein, 488 aa, Antithamnion sp.
MSNSVEERTRIKNERYESGVIPYAKMGYWDPEYAVKDTDILALFRVSPQPGVDPIEASAAVAGESSTATWTVVWTDLLTACDLYRAKAYKVDAVPNTSDQYFAYIAYDIDLFEEGSIANLTASIIGNVFGFKAIKALRLEDMRIPVAYLKTIQGPATGIIVERERMDKFGRPFLGPTVKPKLGLSGKNYGRVVYEGLRGGLDFLKDDENINSQPFMRWKERFLYSMEAVNRSIAATGEVKGHYMNVTASTMEDMYERAEFAKQLGTVIIMIDLVIGYTAIQSMGIWARKNDMILHLHRAGNSTYSRQKIHGMNFRVICKWMRMAGVDHIHAGTVVGKLEGDPLMIRGFYNTLLLSELAIDLPKGIFFEQDWAALRKVTPVASGGIHCGQMHQLLDYLGNDVVLQFGGGTIGHPDGIQAGATANRVALESMVIARNEERDYVAEGPQILLDAAKTCGPLQTALDLWKDITFNYTSTDTADFVETPTANV

SEQ ID NO: 10007 - protein, 402 aa, Methanosarcina acetivorans C2A
MRWIEMAIVAADTVWVLISSALVLLMLPGLALFYGGLVQRKNVLSSMMHSFVAMGVMALEWVIIGYSLAFGSGNGFIGSLEHVFLKGIDPYSVTGTIPTYAFIAFQGMFAIITPALISGAIVGRVKFKSYIAFIALWGLIVYAPVCHWVWGGGFLTGEALDFAGGTVVHITSGISSLAILTFLGKRRGYGIDSIKPHNVTLTLLGTGLLWFGWFGFNAGSSLAANEIAALAFITTLVAPAAAGFVWMTLEWIHLGRPTALGFATGVLAGLVAITPAAGFVTPMAAIPIGVVTSFICYQAVMLKGRLGYDDSLDAFGVHGVGGISGAILTGVFASIGSSGLLLGNSEQLMLQVEGVIATLVYASVCTLIIGFVLHKTIGLKVSESEENIGLDRTQHGEAAYNI

SEQ ID NO: 10008 - protein, 385 aa, Methanothermobacter thermautotrophicus str. Delta H
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 10009 - protein, 427 aa, Batrachospermum ambiguum
IEAAAAVAGESSTATWTVVWTDLLTACDLYRAKAYKVDAVPNTSDQYFAYISYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAATGEIKGHYLNVTAATMEDMYERAAFAKELGSIICMIDLVIGYTAIQTMAVWARKADMILHLHRAGNSTYSRQKIHGMNFRVICKWMRMAGVDHIHAGTVVGKLEGDPLMIKGFYNTLLLSHLDINLPQGIFFEQDWASLRKVTPVASGGIHCGQMHQLLDYLGDDVVLQFGGGTIGHPDGIQAGATANRVALESMVLARNEGRDYVNEGPQILREAAKTCGPLQTALDLWKDISFNYTSTDTADFV

SEQ ID NO: 10010 - protein, 299 aa, Pseudomonas aeruginosa UCBPP-PA14
MAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 10011 - protein, 289 aa, Arabidopsis thaliana
MVSLETTLALQLPVIDFTSRDLKPGTIQWDSVRADVRRALEEYGCFEALFDKVPLELRKAVFDASEEVFQLPLETKKRVVSKRKYRGYVGQIPTLPLFEVMGVDFAENPDKVNAFTHKLWPQGNNNFSEAVMSFAEKVSELDFMTRRMIMESFGLDESYIKEHLNSTKCLNDVKDGIEVKTKDDKHWIKANPSQDSSFIVLGGAMLHALLNGRVLTGVHRVMRMGANIRFSAGLFSVPKTEDLIYAPEELVDAEYPRLYKPVDFEAYFRYTIEGPGRRDLSALRTYCGL

SEQ ID NO: 10012 - protein, 437 aa, Oryza sativa
  unsure (1)..(437): unsure at all Xaa locations
HEGLRPGSLSLSLSLSSSSSSPSPSHRHQLLRPSAIAADRSIRSHSFSDAGDGRFPPGEYEYGRVXIMSGGVEPETPPGSSSGGSTPVGGKPPRHHLTSIRHCASSARIAAATAEFDLGAGTLSLISPTDIRPGFLPVFRSGSCADIGTKSYMEDEHVCVDNLIEHLGVRTPVIPAPGAFYGVFDGHGGTDXAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIXGCDGLWDVMTSQCAVTMVRKELMTHNDPERCSQELVQEALRRNSCDNLTVLVVCFSSDPPPQIEVPRFRVRRSISMEGLHMLKGALDSNA

SEQ ID NO: 10013 - protein, 954 aa, Streptomyces avermitilis MA-4680
MTAQTPPTPSFRDPRLPFAKRVDDLLARLTLDERIAFLHQFTPAVERLGIAAFRTGQEALHGVAWMGPATVFPQAVGLGATWNDDLVRRIGEAVSAETRAMRARDDRVGLNVWSPTVNLLRHPLWGRGEEGYSEDPRLTSAIATAYTRGLRGDHPTYWRTAPVLKHWLAHNNETNRDTTSSSVRPRVLHEYDLRAFRETVEAGAVAGVMPAYNLVNGRPNHVSPYLREHLRTWTDQELLVCSDAGAPSNLVDSEHYFDTHEEATAAAVLAGVDSFTDHGTDSSKIVERVRGALVQGLLSEADIDEAVRRQLAIRFRLGEFDPRLDPYAGTLDFDTAAHRALARESAEQAVVLLKNEGLLPLGPEVRIAAVGLLADECKLDWYSGTLLHRSTPLEGLYERFGADRVNFAEGVDRVRLRTSSGAFLRVPVAENAAEVTADEARGAEGALDPALLAGRTDLPPLTTDAVGSELALIDWGEGVLTLRAPDGRYLSVADDGYVRASADQPGGWVVQETFRLEPSESHDNGHLLKHTGTGRYVCVAADGVKVAAQEPRDAEIFELESTERGEDAVTRVAAAADVVLVFAGNDPHINGRETEDRTTLRLPAHQERLLRAARAANPATALVLVSAYPYAVDHADLPAALWTAHGGQAAGTALARVLSGDVSPAGRLPQTWYADDADLPGLLDYDVIGSRQTYLYFEGTPLFPFGHGLSYASFAYEGLEHRTDEDTVRVSFTVTNTGSRAADEVAQLYIRAVDPSVPRPRRELAAHRRLRLAPGASAELAFALPSAAFAFWDVAHGRRRVEPGSYELLVGASSEDIRLRTTIELTGEAAAPRAVRALGLKAADFDDQRNTEIVDRTKVSGDAVTPLDGGTGELVFRACDFGAGVSGVSADLAGEGVVEISLAGGPPPAVLTLPPTKGPYDYTTVTAAFAADGVHDVHLRLRGPLRLAQVGFSG

SEQ ID NO: 10014 - protein, 557 aa, Zea mays
MAAPPTEDCGWLLYLSLAAKCGDPSRLLGLAAVFVGACVVTSLLHWACPGGPAWGRYWWTRRGGLGIVRAAIPGPRGLPVVGSMGLMTGLAHRKLAAAAAAAGGQGSSRRRRLMALSLGETRAVVTGDPDVARELLGSAAFADRPVKESAYGLLFHRAIGFAPHGAYWRALRRVASAHLFSPRQVAASSAQRAVIARQMVDAVTTAAPAPAPAVVVARRFLKRASLHNVMWSVFGRRYDLLLLAADGEELKALVDEGYDLLGQLNWSDHLPWLARFDLQRTRARCSALVPRVNRFVGNIIDEHRARLGLGDTGGVTDFTDVLLSLQGVDKLSDADMVAVLWEMIFRGTDTVAVLMEWVLARLVLHQDVQSKVQEELDRVVGPPGQAASVTESDTASLVYLQAVIKEVLRLHPPGPLLSWARLATSDARVGGYHVPAGTTAMVNMWAITHDPSVWAEPTEFRPERFVGASAGAGAGAGAEDVPMIMGSDLRLAPFGSGRRSCPGKSLALATVGFWVATLLHEFKWLPPCRGVDLSEVLRLSCEMAAPLEARVVPRHAV

SEQ ID NO: 10015 - protein, 143 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 10016 - protein, 184 aa, Zea mays
  unsure (1)..(184): unsure at all Xaa locations
METPLSTRRITRSLAAASAQKSAAAGMDSAALFSLSKNAAAGETHAQTRAALHDITNDSPVVGLAAGSLHATDTTPAKTRRRPXRCTPGSGEALLRGQVKALLHKVDEEXGLRAAGALVRPKRIQALLGVSRSPAQLLAPTPANTPQIGPVSAPREGVGLHDGATVVPCVIDEEELLIPKLQVM

SEQ ID NO: 10017 - protein, 557 aa, Chloroflexus aurantiacus
MWPLVRQARHLGRYREIAQVLVHHGFGYLVDQLGLSGLLSLPRRVILRAPAPPPLGSAARLREALIELGPTFVKLGQALSTRPDLLPADVVAELSKLQDTVPPFPGDQAVALIEATFNRPLDQLFIAFDRQPFAAASLGQVHAAVLPDGTQVVVKVQRPDIASRIQTDLAILADLATLAQERLAFAAQYNLSEIVWEFSAMLRAELDYVREGRNAERFRQMFCTNPHIYIPRVYWEYTGSRILTTERIVGVKLNDMAGLRAAGVDMSRLARASLDITLEEIFTHGFFHSDPHPGNFFVLDGDVLGVVDFGQVGTLDHATMQGLLWLMGALVNHDSQGLLRSLERLEVIPRRAANLALRRDLERFVEGFVDRPLGLISARETFDGLTTLLRRHRLTIPGPLATLLKTIVMMEGLGMQLDPNLNVFAAARPYIQRALREQMNPTALGAQALAGGRELGELAFDLPIQISQTLQHLNDGELRIQTRELELRRLAAALIGAANRLALALVVAAFIVGVAALVIAMRALDWYGVLPWTLLFIGIGGVITGGIMLTLALLRRE

SEQ ID NO: 10018 - protein, 583 aa, Xylella fastidiosa Ann-1
MNRSAHSATRNGASWLTHALEAEGVDTLFGYPGGTIMPFYDALVDSRLTHILVRHEQGAALAANGYARASGRVGVCVATSGPGASNLITGIADAMLDSVPMVCLTGQVASSLLGTDAFQELDVFGLTMPIVKHSFLVRSIQDLPSMVQDAFRIAREGRPGPVLIDLPKDVQMTDASHLQDHVSAAVMAPPQAEAAMIIEAAAAIASAEKPVIYGGGGIALADAVNVFRTFVDTTSIPTTLTLRGLGALPHAHPHYLGMLGMHGTRAANMAIQECDLLLVIGARFDDRATGKVNEFAPFARIVHLDADAYEINKLRNADIAVPGNLATTLTALSASLSPSTAHPHISSSRYEWHERCIGNRERFGVRYDAPGNDIYAPALLKRLSEMAPVDTIIACDVGQHQMWVAQHCKFEDPRNHLTSGGLGTMGFGLPAAMGAQFAYPERTVVLVSGDGSFMMNVQELTTIARCKLPLKIVLLDNNSLGMVRQWQELFFAERYSEIDLSDNPDFTALVQVFGIPAKRITVRSDVEQGLAYLLAQPGPALLHVQIDARANVWPLVPPNTANSTMLESNPAHVQKETPHAIPA

SEQ ID NO: 10019 - protein, 374 aa, Streptomyces purpurascens
MSSSSPGEPLEPTDQDLDVLLKNLGNLVTPMALRVAATLRLVDHLLAGADTLAGLADRTDTHPQALSRLVRHLTVVGVLEGGEKQGRPLRPTRLGMLLADGHPAQQRAWLDLNGAVSHADLAFTGLLDVVRTGRPAYAGRYGRPFWEDLSADVALADSFDALMSCDEDLAYEAPADAYDWSAVRHVLDVGGGNGGMLAAIALRAPHLRGTLVELAGPAERARRRFADAGLADRVTVAEGDFFKPLPVTADVVLLSFVLLNWSDEDALTILRGCVRALEPGGRLLVLDRADVEGDGADRFFSTLLDLRMLTFMGGRVRTRDEVVDLAGSAGLALASERTSGSTTLPFDFSILEFTAVSEEAAPAAQASEALPAQE

SEQ ID NO: 10020 - protein, 316 aa, Zea mays
EGEKPDSIISTNLNFNGKLQPDASNGTAQIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHD

SEQ ID NO: 10021 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARXALQGADVVLISAGVARKPGMDRSDLFNVNAGIVKNLVQQIAEVCPKACIGIITNPVNTTXXIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLGSRPAGEKGVVECAYVEGDGQYAR

SEQ ID NO: 10022 - protein, 261 aa, Glycine max; identical to SEQ ID NO: 3788

SEQ ID NO: 10023 - protein, 306 aa, Lactobacillus plantarum WCFS1
MSKVRKAVIPAAGLGTRFLPATKAMPKEMLPIVDKPTIQFIVDEARKSGIEDIVIVTGKSKRSIEDYYDSNPELEDNLRAKHKEEMLKLVQETTDINLYFIRQSHPRGLGDAVLTAKAFVGDEPFVVMLGDDLMEDKVPLTKQLMNSYDKTHASTLAVMKVPHEEVSKYGVINPESEKEPGLYNVNNFVEKPSPEDAPSDLAIIGRYLLTPEIFDVLENQKPGKGDEIQLTDAIDTLNKTQRVFAHEFKGTRHDVGYKFGYLKTTIEYGLTHPDVKADLRTYIKDLGAKLSKEDSAAPKTTKKPTK

SEQ ID NO: 10024 - protein, 492 aa, Triticum aestivum
MDPYKYRPSSSFNAPMWSTNSGAPVWNNDNSLTVGSRGPILLEDYHLVEKIADFDRERIPERVVHARGATAKGFFEVTHDVSHLTCADFLRAPGVQTPVIVRFSTVIHERGSPETLRDPRGFAVKFYTREGNWDLLGNNFPVFFIRDGIKFPDVVHALKPNPKSHVQEYWRVFDFLSHHPESLHTFFFLFDDVGMPADYRHMDGSGVNTYTLVNRAGKAHYVKFHWKPTCGVKSLLEEEAVTVGGTNHSHATKDLTDSIAAGNYPEWTFYIQTIDPDHEERFDFDPLDVTKTWPEDVVPLQPVGRLVLNRNIDNFFAENEQLAFCPGIIVPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 10025 - protein, 319 aa, Triticum aestivum
MAPSRPLMRGAGPPRVFGSGRAGRASPYALALAALLLASAFLLALIAFGVFSLPVSSPALPTTGAETESSGDGGAAESDASGGSSRAARSRARRDLSEGLGERGAQWTEVISWEPRAFVYHNFLSKEECEYLIGLAKPRMVKSTVVDSETGKSKDSRVRTSSGMFLQRGRDKVIRAIERRIADYTFIPAEHGEGLQVLHYEVGQKYEPHFDYFLDEFNTKNGGQRMATILMYLSDVEEGGETIFPDANVNSSSLPWYNELSECARKGLAVKPKMGDALLFWSMKPDATLDPLSLHGGCPVIKGNKWSSTKWLHVHEYKA

SEQ ID NO: 10026 - protein, 416 aa, Escherichia coli O157:H7 EDL933
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIKNM

SEQ ID NO: 10027 - protein, 437 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNDEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSYLIKFNQIGSLTETLAAIKMAKDAGYTAVISHRSGETEDATIADLAVGTAAGQIKTGSMSRSDRVAKYNQLIRIEEALGEKARTTVVKRSKARHKTDFI

SEQ ID NO: 10028 - protein, 480 aa, Brucella melitensis biovar Abortus
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 10029 - protein, 117 aa, Triticum aestivum
  unsure (1)..(117): unsure at all Xaa locations
MDPGRGYMSGMGYALSWDLXQWVAGXGEVTRGRTVGPEDRMTGEWXRVGGKGKNRFNAKPAMYDYPLPVPVDQCSHEFVPDTIAVHRLKDNPRWAHALGYFNFTAGLKPXKXYKFDP

SEQ ID NO: 10030 - protein, 198 aa, Streptococcus pneumoniae
GIEDILVVTGKSKRSIEDHFDSNFELEYNLKEKGKTDLLNLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 10031 - protein, 167 aa, Nostoc sp. PCC 7120
MMKKPHPDAPGITVNCAVVTVSDTRTPETDKSGHLIQQLLIDANYTVDDYVIIPDEPAQIQLQLALLSQNSNLDAVIFNGGTGIAPRDTTYDAIEKLLEKTLPGFGEIFRYLSYQEIGSRAIASRAVAGVYKNQLIFSLPGSSNAVRLGMEKLILPELTHLVSQVRK

SEQ ID NO: 10032 - protein, 128 aa, Yersinia enterocolitica
EDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEA

SEQ ID NO: 10033 - protein, 394 aa, Arabidopsis thaliana
MAKKGKEVLNALDAAKTQMYHFTAIVIAGMGFFTDAYDLFSISLVTKLLGRIYYHVDSSKKPGTLPPNVAAAVNGVAFCGTLAGQLFFGWLGDKLGRKKVYGITLMLMVLCSLGSGLSFGHSANGVMATLCFFRFWLGFGIGGDYPLSATIMSEYANKKTRGAFIAAVFAMQGFGILAGGIVSLIVSSTFDHAFKAPTYEVDPVGSTVPQADYVWRIVLMFGAIPALLTYYWRMKMPETARYTALVARNTKQAASDMSKVLQVDLIAEEEAQSNSNSSNPNFTFGLFTREFARRHGLHLLGTTTTWFLLDIAYYSSNLFQRHLHSNRMDSRRRNNERNPRSLHRLKSSNPNRSLRHRPWLLVHRRIHRYTRSILHPVDGIYLHDDLYVRFSDSL

SEQ ID NO: 10034 - protein, 509 aa, Zea mays
WRGATIDVLRLWASKAATHEHDFLSLYAAAAAKDAPLLLHDSKAPPPSQGNFLLKTHDFLQPLDQKPGAPPEPSPLPASAAESRHQPQQQVVVANQHALPLPGGVGTFSISPAPVSVALPAAVVKSEPPFVLWGQPAATLHPGARGHQQQWALPFAGAGQVRLPPQQAPPDRKGRGGAGGGVMESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENAKMLPWSKGQISGDSPPDPSHFMRNGSSPGSNFTGKLDDNHNIVTSAAASGAQDQVETDHMASGCYRSAETTANFTNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 10035 - protein, 488 aa, Caepidium antarcticum
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYQRAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEERDYVGEGPEILRRAATTCGPLKAALDLWKDITFDYTSTDTPDFVETATESR

SEQ ID NO: 10036 - protein, 213 aa, Glycine max
MKGSFLHDLANGISVASTYHVGKSSKRYLLPDSCGKYSKSITKSKQNRAPFHHKSGFLQRFREHVRLGPKITDTVKGKLSMGARILQVGGVEKVFMQLFSVREGEKLLKASQCYLSTTSGPIAGLLFISTHKVAFCSDRSIKISSPNGDDVRVHYKVSIPLTKLKSVNKSQNVEKPSQKYIEIVTVDNFDFWFMGFFNYQKALRCLQQAVPQA

SEQ ID NO: 10037 - protein, 326 aa, Streptomyces coelicolor A3(2)
MTDSRAGLGPQAAGGLLTFGETMGLVTATTIGTLEYARDFTFGIGGAESNVAIGAARLGAPVTWIGRVGSDAAGDLVGRRMRAEGIQTVAVRDTSFTGLMVRHHRAATVVHVDYHRAGSAGSRLTAHDIPVGEIRRAAILHLTGITPALSASARQATWDAVAAAKANGVRVSLDVNHRSKLWDRDTARRELRRLVAEADIVFAGIEEAQLVLDSEADAPESLADALAATGPGETVVKTGARGCTAHIDGAIHEEPALSVPVVDTVGAGDAFVAGYLAEHLRGAGPVQRLRTACAMGAYAVSVPGDCELLPTRSELETFLTTGDVLR

SEQ ID NO: 10038 - protein, 537 aa, Saccharomyces cerevisiae
SEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 10039 - protein, 484 aa, Agrobacterium tumefaciens str. C58
MKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 10040 - protein, 355 aa, Trichoderma atroviride
MGGCMSSNNDEVEQKKRSQAIDKELDEDSKRLRKECKILLLGSGESGKSTIVKQMKIIHLKGYSEEELYNYRPTVFKNLVECAKAVITAMQQFSIELAQDDNRAHADFLIDYQAESGPQAHIDPKVGLAVQAIWSDPAKEQLMEHQTEFYLMDSAEYFFQEAMRIVAPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLSNFFPDYTGGTDVNKAAKYLLWRFNQVNRAHLNLYPHLTQATDTSNIRLVFAAVKETILNNALKDSGIL

SEQ ID NO: 10041 - protein, 521 aa, Zea mays
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 10042 - protein, 527 aa, Triticum aestivum
MALEAAFHYLQLAGIHGTSTPAVLLTILLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIHEAATRGTAVDMSELLSGYTNDVVCRAVLGESHRKEGRNRLFSELTEINVSLLGGFSLENYIPPNMVMADVLLRLVSVKARRLNKRWDELFNEIIEEHLHPSKPSSGDQQAVDFIDLLLSLKEEYGLTTDNIKAILVDMFEAGIETSYLTLEYGMAELMNNRHILKKLQEEVRSQGKKLDMITEEDLGSMAYLRATIKETLRLHPPAPFLLPHFSTADCKIDGYLIPSNTRVLVNAWALGRDPSSWERPEDFLPERFLQDQDGDVDTQMRGKDLRFLPFGFGRRICPGMNFGFATMEVMLANLMYHFDWDVPNMVGTGAGVDMAESFGLTLRRKEKLQLVPRIP

SEQ ID NO: 10043 - protein, 248 aa, Rosa hybrid cultivar
MAYENKPNTVLDADAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIADNERHQQSINAIAGGHGSYEIMQPTQPFHEARNYFQVNALEPNIHQYSRHDQISLQLV

SEQ ID NO: 10044 - protein, 701 aa, Oenococcus oeni MCW
MMVSDGPSGLRKQADASNALGLNKSVVAVNFPSSSLTAASFDRALLQELGRNLGQAAKAERVRILLGPGINLKRSPLAGRNFEYFSEDPYLTGELASSYVQGVQESGVGVSLKRFAANNREDQRFTASSNIDQRSLHELYLSAFEKAVKMARPATIMCSYNAINGTLNSQNQRLLTQILREEWGFKGLVMSDWGAVSDHVAALKAGLDLEMPGKGNESTSEIIEAVNKGQLDEKVLERAASRVIQMVEKWQPENKTVISYDLEKQHRFARQLVGESIVLLKNEQQLLPLKSNQSLAVIGQLAEKPRYQGSGSAHVNAFNTTTPLKVVQDILPKTAYQAGYQIDSDQIDQQAEQAAVDLAKQADQVVVFSGFPSSYESEGFDKKTISLPDNQNHLIERLAAVNKKIIVVLENGSALEMPWVGQVEAIVETYLAGEAVGEATWDILFGRVNPSGKLAESFPIKLADNPTYLTFNADRKNENYHEGLFVGYRYYDKKKQEVLFPFGHGLSYTTFEYRKLELLKSDHEVTVSFEIKNTGSVAGKETAQIYLSNQTSEIEKPLKELKGFAKVSLNPGQTKQVEIVLDKRSFSWYNPETDKWQVDNGSYQIQLAASSRDIRLTKNLLIDWSENKVQALSPDSYLSDILKEQAFKAPLKESGLDKLLEQLAGDENNQAILTNMPLRALMMMGVSNHQIQQFIKLANQS

SEQ ID NO: 10045 - protein, 501 aa, Suaeda liaotungensis
MSIPIPSRQLFIDGEWREPIKRNRLPIINPSTEETIGEIPAATAEDVEAAVSAARRALKRNKGRDWAATSGAHRARYLRAIAAKVSEKKDHFVKLETMDSGKPLDEAVLDIDDVSTCFEYFADQAEALDNKQKYPVKLPMDRFKSHVLRQPIGVVGLISPWNYPLLMATWKIAPALAAGCTAVLKPSELASVTCLEFGEVCNEVGLPPGVLNILTGLGPDAGAPLVSHPDVDKVAFTGSSATGSKVMGSAAQLVKPVTLELGGKSPIIVFEDVVDLDVAAEWTIFGVFWTNGQICSATSRLLVHESIAAEFVEKLVKWSKKIKISDPFEEGCRLGPVISKGQYDKIMKYISTAKSEGATILCGGSRPEHLKKGYFIEPTIVTDITTSMQIWKEEVFGPVLCVKTFSTEEEALELANDTEYGLAAAVFSKDLERCERVTKALEVGAVWVNCSQPCFCHAPWGGVKRSGFGRELGEWGIENYLNIKQVTSDISDEPWGWYKSP

SEQ ID NO: 10046 - protein, 319 aa, Corynebacterium efficiens YS-314
MVTAHTDSAHSTPLRTVVVPAAGLGTRFLPATKTVPKELLPVVDTPGIELVAEEAAEAGAQRLAVITAPAKDGILAHFGDFTELRDHLVTKGKTAEAAKVARAVEIITVQGVVQEEPLGLGHAVSLAEGALDDNEEIFAVMLPDDLVLPIGVTSQMIRVQEQFGGTVLCAMDVPLEEVSKYGVFDIADIPGQPGVKQVLGMVEKPSQEKAPSTFVATGRYVFDRHIFDALRRTTPGKGGEIQLTDAIDLLIREGHPVHILVHEGQRHDLGNPGGYIIACMELGMEHPVYGASIREAVTRAAAALAPATLASVQPLTSSS

SEQ ID NO: 10047 - protein, 345 aa, Acholeplasma laidlawii
DQNGKVVNEKMEPKLPKETLLKMYKTAVLGRNADIKALQYQRQGRMLTYAPNMGQEAAQIGMAAAMEPQDWNSPMYRELNTLLYRGDKLENVFLYWYGNERGSIKPEGVKILPTNIIIGSQSNIAAGLAMASKIRKTNEVTAFTIGDGGTAHGEFYEGLNFAASFKAPVVAVIQNNQWAISTPVRKASNSETLAQKGVAFGIPYIQVDGNDMLAMYVASKEAMDRARKGDGPTLIEAFTYRMGPHTTSDDPCSIYRTKEEENEWAKKDQIARFKTYLINKGYWSEEEDKKLEEEVLAEINDTFKKVESYGANVELIEIFEHTYAEMTPQLKEQYEEHKKYLEGVK

SEQ ID NO: 10048 - protein, 206 aa, Saccharomyces cerevisiae; identical to SEQ ID NO: 470

SEQ ID NO: 10049 - protein, 426 aa, Hordeum vulgare subsp. vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 10050 - protein, 97 aa, Zea mays
MDEEEHEVYGQEIPEDGDMDGADVDMAASGDDAAKLQELDEMKRRLKEMEEEAAALRDMQAKVAKEIGEIEPTNHGTAWQPCPAPPTAPACPFPCVT

SEQ ID NO: 10051 - protein, 457 aa, Chlorobium tepidum TLS
MIVTINPATGEQLAEYPVMIAGQIDSVLRQADADFRRWRSTSFGERRTCMKRLAELLREQAEKHGRIITLEMGKPFSQAVAEVNKCAWVCDYFADHAEEFLQPEQSEIDGAKGIVAFEPLGVILGVMPWNFPYWQVLRFAAPILMAGNGIVVKHAPNVTGCAIAIEKLFRDAGFPEHLYRAVHIDLDEVDRLTGFMIDHPVIKAVSVTGSTGAGQAVAAKAGKALKRSVLELGGSDPYIVLEDADLAQAVDACVAGRLLNAGQSCIAAKRFIVRKEIIGEFTKKIVQRMQTAVMGDPFAKSTEVGPIAREDLRDLVHSQVQRSVEAGAELLWGGHVPNAPGWYYPPTVLSGVKPGMPAYSEEIFGPVATIIEVADDDEAVAIANDSEFGLGSAVFSQDVERALGIARRLEAGSCFINTMVKSDPRLPFGGVKQSGYGRELSHHGIREFVNIKTFYLP

SEQ ID NO: 10052 - protein, 599 aa, GIBBERELLA ZEAE PH-1
MADFANFDGTPSSLGSDTNHRKAAILERHLPDGYSAEPDVAFGPANPSGSASASAANADDDSQAEPVESSLLLQGGDMHRDMFKIKARASSLRRAATFSHHAVPRLASEDELSHSEQREPGGFRRYHIQRRARQRRMSGYTIVAKNFVDFLDLYGSFAGEDLEDNDSEDESAIDDREDGDVEQPPELRPLLGRRRSSKRLRKTGDATTTKTFFTLIKAFIGTGIMFLPKAFRNGGILFSSITLIVLSLVNCGCFRLLLDCRQIYGGGYGELGEAIIGPRFRSLVLASIAISQLGFVCAGLIFTAENLYAFLDAVTANHRELMFSVPTLIALQLVALVPLALIRNISKLGPAALLADVFILIGIVYIWYYDIAALSQHGMDSTVKLFNPRDFTLTIGSGIFTFEGIGLILPIQSSMKRPEHFPGLLYLVMFIITIIFTSVGALCYATFGEDTKIQVISNFPQDSPLVNAVQFLYSIAVLAGDPVQLFPAARIIETSIFGERATGKKSIAIKWKKNALRTFIAGVCVGVSILGASDLDKFVALIGSFACVPLVYIYPALLHYKGAAQTTRAKVIDVIVMVVGFIAMVYTTLVTVYQWIDSV

SEQ ID NO: 10053 - protein, 150 aa, Zea mays
EAIFVDPALRGKYCVCFDPLDGSSNIDCGVSIGTVCHCHSRWCFKPSYHRDIYTRARCYIRICSLQIFGIYIRLEVKDKDNVTLEDVLQPGTNMLAAGYCMYGSSCTLVLSTGNGVNGFTLDPSLGEFILTHPNIKVNDKKNSTLLFFPG

SEQ ID NO: 10054 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEAEPKADA

SEQ ID NO: 10055 - protein, 472 aa, Nitophyllum wysorii
ESGVIPYAKMGYWDPNYVIKETDILALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSIEAVNRSIAATGEVKGHYMNVTAATIEDMYERAEFAKQLGTVIIMIDLVIGYTAIQTMGIWARKNDMILHLHRAGNSTYSRQKIHGMNFRVICKWMRMAGVDHIHAGTVVGKLEGDPKMIKGFYDTLLEPYLDINLPEGIFFQQDWASLRKVTPVASGGIHCGQMHQLLDYLGNDVVLQFGGGTIGHPDGIQAGATANRVALESMVIARNEGRNYVAEGPQILRDAAKTCGPLQTALDLWKDITFNYTSTDTADFVETPTANV

SEQ ID NO: 10056 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPAEHNWPGISQFPEYKATAPRYATQDLRQILPQIDATGIDLLQRLLQLRPELRISAHDALQHPWFHDILQYQHCQQAAG

SEQ ID NO: 10057 - protein, 794 aa, Neurospora crassa
MAESTSVSLSSAHLVGTVANPPKLDESEYLREVFGITTEDATATEAEIEESLTAKASSLGIDVSNLTDSLGNPTALNATSARSSTLVAHQRSNTICSNDSTTGTETATGTDNDMASNSSAAMPATLTQSTSRKRSNTVNFSQYEKYLTQLKPALHQPKFSNPAAPTRRPSHNIFGFGHFKGVRELRRGLTGRLKRRKTYPALPIVICICCREEFAQENHLLQTLPCGHTYCQNCLAVMINQSTTDESKMPPRCCTQPIPSSIIKTILTREEQQAFLKAVLQYSTPWESRIFCPNPACGEFIPPRAKLDPKHPFETMCKTCKMRVCLICKRSAHRLGQDCPEDIELETVLKMGEKSGWRRCYKCRNLVELTQGCTHMTCRCKAQFCYICGAVWDPVVGCPNFCNGEEELERRRREEETRLAELEVKKREQEEAAAAEGRAQQAAERRTRDSVEFQALRERQNHEMSRVLAYEARMRKDMRTKQSEKKKALLEKYAELTEKMKERHAKTEQHLEDRQIEAEMELRSSLDASERSIKIQLKHMEAYCKTLSQVEEVSEKDQALQDSKMPSREVTQKHLDQLSEQYRIRDGMERRHQAQINVLREKQGKKMEQLLDRHEDEMEALLHKKSEELEDLAVEFANEADAVSRTFAQRKVKLQKRWLVSVEILRVEQEKKTGMRYASMAVPQWPAATTTESDTETESEEEETTAAAHLQEQEVIELARPKAEAEMKEDGWPLSNNDNIKTTEIELPSTPKTVTPAVTPTQARFEAELRRYRSRTRLVAPGEQSPPVSPRTMR

SEQ ID NO: 10058 - protein, 117 aa, Schizosaccharomyces pombe
MSESPSANISDADKSAITPTTGDTSQQDVKPSTEHINLKVVGQDNNEVFFKIKKTTEFSKLMKIYCARQGKSMNSLRFLVDGERIRPDQTPAELDMEDGDQIEAVLEQLGGCTHLCL

SEQ ID NO: 10059 - protein, 419 aa, Polyopes constrictus
ETDVLALFRITPQPGVDPVEASAAVAGESSTATWTVVWTDLLTACDLYRAKAYKVDAVPNSSEQYFAYISYDIDLFEEGSIANLTASIIGNVFGFKALKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGSGEVKGHYMNVTAATMEDMYERAEFAKQLGTVIVMIDLVIGYTAIQTMGIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDFVGEGPQILQNAAKTW

SEQ ID NO: 10060 - protein, 358 aa, Thermosynechococcus elongatus BP-1
MSHAVTLIRGDGIGPEVAAAARTAIDATGVKIDWVVVDAGVAMMERYGTPLPEEVIDAIKSTKTAIKGPITTPVGTGFRSVNVEIRKRLNLYANLRPAKSIVGVKSYFQNIDLVIVRENTEDLYAGIEFAYTSPEAAKARAFLSDLSGKPIREDAAIGVKPISVLGSDRILEFAFKYAKANGRKKVTAVHKANIMKFTDGLFLERAREIASRYPDIVFEDRIVDNMCMQLMQKPELYDVMVMPNLYGDILSDLCAGMIGGLGVAPGANIGDECAVFEAIHGSAPKYAGQNKANPTALILSGVLMLQHLGEMEAAQRLQAAVEKVIAEGRFVTYDLAAPGKEPVGTQEMAAAIAEYAAP

SEQ ID NO: 10061 - protein, 336 aa, Synechocystis sp. PCC 6803
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 10062 - protein, 481 aa, Corynebacterium efficiens YS-314
MASSPTTNPDEILKFIRDNDINWVDVQFTDVPGTEQHLSVPAAAFDESAMENGLAFDGSSISGYTTVDDSDMMLLPDLSTAFIDPFRRSKTLNIKFFVHDPYTREPFSRDPRNIARKAEEYLASTGFADSCNFGAEAEFYIFDSVRFSSQSNAAFHEVDSVEGWWNSGSRENPDGSRNLGHKVRQKGGYFPVAPYDHFQDLRDTIGETLAEIGFTVERSHHEMGSGGQQEINYRFNTLLRAADDLQTFKYVVKNTAKAVGKSATFMPKPLADDGGSGMHIHQSLWKDGKPLFHDEAGYANLSEMARHYVGGLLKHAPAVLAFTNPTLNSYNRLVPGFEAPVSLAYSQQNRSAAIRIPASGPNPKATRIEFRTPDPSGNPYLAFTASMMAGLDGIRNRIEPDAPLDKDLYELPPEEAAKVAEAPTSLEQALKALEEDHEFLTEGDVFTDDLIEAYVAYKHEHEITPERLRPTALDFELYYDC

SEQ ID NO: 10063 - protein, 129 aa, Yersinia pseudotuberculosis
IGVVGMAVMGSNLALNIESRGYSVSILNRSSDKTDEVVAENPGKNLVPSYTVEEFVDSLEKPRRILLMVKAGEATDKTIASLTPHLDKGDILIDGGNTYYKDTIRRNRELSAQGFNFIGTAVSGGEEGP

SEQ ID NO: 10064 - protein, 523 aa, Nicotiana tabacum
MAGGGGIGPGNGKEYPGNLTLYVTVTCIVAAMGGLIFGYDIGISGGVTSMDSFLSRFFPSVFRKQKADDSTNQYCKFDSQTLTMFTSSLYLAALLSSLVASTVTRKLGRRLSMLCGGVLFCAGALINGFAQNVAMLIVGRILLGFGIGFANQSVPLYLSEMAPYKYRGALNLGFQLSITIGILVANVLNYFFAKIHWGWRLSLGGAMVPALIITIGSLFLPETPNSMIERGNHDEAKARLKRIRGIDDVDEEFNDLVVASEASRKIENPWRNLLQRKYRPHLTMAIMIPFFQQLTGINVIMFYAPVLFKTIGFGADASLMSAVITGGVNVLATVVSIYYVDKLGRRFLFLEGGIQMLICQIAVSICIAIKFGVNGTPGDLPKWYAIVVVIFICVYVAGFAWSWGPLGWLVPSEIFPLEIRSAAQSINVSVNMIFTFIVAQVFLTMLCHLKFGLFLFFAFFVVIMTVFIYFFLPETKNIPIEEMVIVWKEHWFWSKFMTEVDYPGTRNGTSVEMSKGSAGYKIV

SEQ ID NO: 10065 - protein, 303 aa, Glycine max
MAATSTSLFSSNLHSLNSQPFSSSLSFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 10066 - protein, 194 aa, Zea mays
MAIKKVFARSVYDSRGNPTVEVDVVTETGLHRAIVPSGASTGQHEACELRDGDKSKWNGKGVTKAVENVNTVIAPALIEKNLDVKDQSAVDAFLKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 10067 - protein, 352 aa, Bacteroides thetaiotaomicron VPI-5482
MKQIKKLGLVVVTLLLSATMAFAAKPNIHILATGGTIAGTGSSATGTSYTAGQVAIGALLDAVPEIKDIANVTGEQIVRIGSQDMNDEVWLTLAKKINELLKRPDIDGIVITHGTDTMEETAYFLNLTVKSDKPVVLVGAMRPSTALSADGPLNLYNAVVTAAAKESKDKGVLVAMNGLILGAESVVKMNTVDVQTFQAPNSGALGYVLNGKVCYNQITLKKHTTQSVFDVTKLTSLPKVGIVYSYSNIEADMMTPLLNNGYKGIIHAGVGNGNIHKNIFPSLIDARRKGIVVVRSSRVPTGPTTLDAEVDDAKYQFVASQELNPQKSRVLLMLALTKTTDWKQIQEYFNEY

SEQ ID NO: 10068 - protein, 455 aa, Porphyra amplissima
VIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKNDMILHLHRAGNSTYSRQKNHGMNFRVICKWMRMAGVDHIHAGTVVGKLEGDPLMIKGFYNTLLESDTEINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 10069 - protein, 300 aa, Candidatus Tremblaya princeps
MRVTTEVVNVAGSSPVRCSLRVMPGLSFEFFAPRSHAGSIRLMCAQQVLSRFVPRFVSVTRSTSLGQQAHIDTIASTLSVFPRTAPHVLFCQCPRALARELRAYELLGIRHLVLLRGDNGIAPGSIGAPELVSMVRRSYGEAFYIDVAAYPDGHPMSSTIFEDVRALARKVRCGANSAITQCFYNPDAYYRLQDELQRLGVSLPVTPGIMPVLSHDYMSRFILPSGVDVPAWILKRLEALRYCSASVLEFGTDVALSLCESLAARGASDFHLYTMNDHRAVWRVCEHVLGSADACHRSGA

SEQ ID NO: 10070 - protein, 578 aa, Oryza sativa (japonica cultivar-group)
MELSSLAALLHSPLLLAVLLLVFSWLIVSSTKKRPPPPCGDGGRRLPLPPSPPGVPLLGHLPLLGTLPHRKLRSMAEAHGPVMLLRLGRVPAVVASSAAAAEEVMRTRDLAFASRPRVRMSERLFYGRDMAFAPYGEFWRQARRVTVLHLLSPRRVLSFRGVREQEVAALLDRVRRRCGGGGETVNLSDLLMSYAHGVISRAAFGHGGAHGFDGDEGGEKLRKLFADFEGLLGTMTVGEFVPWLAWVDKLTGLDAKVARTSAAMDGLLERVIADHRERRRSRGQAVGDGEADADHRDFVDVMLDVSEAEEGAGAGAGGVLFDTVAIKAVILSKKVPRVTCMNERFIEQDMMAAGTDSSFTTTEWVMAELINHPRVMRKLQDEIRAVVGTSSASAAAAATGGGQVTEDHLGELPFLRAVIKEMLRLHAPGPLLLPRETVEDTELLGYRIPARTRVIINVWAIGRDAAAWGDSAEEFVPERWLDGGGGGGVEYAQQLGKDSRFVPFGAGRRGCPGAGFAALSVELALANLLYHFDWELPPPAASGIMATTRLDMDELFGLSVRLKADLNLVAKPWSPGAS

SEQ ID NO: 10071 - protein, 618 aa, Mycobacterium tuberculosis H37Rv
MSAPTKPHSPTFKPEPHSAANEPKHPAARPKHVALQQLTGAQAVIRSLEELGVDVIFGIPGGAVLPVYDPLFDSKKLRHVLVRHEQGAGHAASGYAHVTGRVGVCMATSGPGATNLVTPLADAQMDSIPVVAITGQVGRGLIGTDAFQEADISGITMPITKHNFLVRSGDDIPRVLAEAFHIAASGRPGAVLVDIPKDVLQGQCTFSWPPRMELPGYKPNTKPHSRQVREAAKLIAAARKPVLYVGGGVIRGEATEQLRELAELTGIPVVTTLMARGAFPDSHRQNLGMPGMHGTVAAVAALQRSDLLIALGTRFDDRVTGKLDSFAPEAKVIHADIDPAEIGKNRHADVPIVGDVKAVITELIAMLRHHHIPGTIEMADWWAYLNGVRKTYPLSYGPQSDGSLSPEYVIEKLGEIAGPDAVFVAGVGQHQMWAAQFIRYEKPRSWLNSGGLGTMGFAIPAAMGAKIALPGTEVWAIDGDGCFQMTNQELATCAVEGIPVKVALINNGNLGMVRQWQSLFYAERYSQTDLATHSHRIPDFVKLAEALGCVGLRCEREEDVVDVINQARAINDCPVVIDFIVGADAQVWPMVAAGTSNDEIQAARGIRPLFDDITEGHA

SEQ ID NO: 10072 - protein, 365 aa, Glycine max
MDWDGKEFAWDPRGLELANGEGQKSEAASVDLRLGEEKTAPDVVAKDTKDSKTVSSPSGSSKRSRLQNGLQNMCCSVDGCNSDLSDCREYHRRHRVCEKHSKTPVVMVGGKQQRFCQQCSRFHSLGEFDEVKRSCRKRLDGHNRRRRKPQPPSLFMAAEKFMYNYKGPRILHFGSPEAYANPIMRDMWPAAAKTGAESGHDSPRLLYRIDKHKQDKGHPLWQENDPKVGSGDEAMPGTPICQPIHGTIAPSMGGKSNRKLSTDAKPGSFDSGCALYLLSTLQSQSPELSMVQSSITCPVQSPSGSVHFDAVNEYACSETERDKPSGQVLVFDAKTTNLHYNGMLQMDLDGFVENEDPLALPFLWE

SEQ ID NO: 10073 - protein, 542 aa, Chlamydomonas reinhardtii
MSEACLLAAKSALVGVANGDSLASAICAAMEAAAPVARHLQETTVDLTTLQETVDTIGLNLQGTMDGLNTLLLLYGGALVFLMHGGSAMLEAGAIRSKNAMNILLQTVLDASCSALMWYFVGFAFAFGIGDKPNKFIGNAMFALVDIDTHNTGSGTGKWIDWFFQWAFAATAVTIPAGAVAERFNFNAYLGYSMFIGGWVYPIIAHWVWCIEGWLGYGVIKPFINAGMIDFAGSGVIHMTGGLAGLIGAIMVGPRLGRFDADGKPVDMPGHSAILVVLGTVLLWFGWYGFNPASVLLINSSTYAIVCGRAAVCTTLAGAAGGVSCLIFGFARHRGWDLVGLCNGILCGFVAVTACPHVIYPWAAIICGLVAGLWFEFLCWLLLKLKIDDPLSAGPMHFGCGMWGVFFTGLFARQQYIQEYYVHGPSAAGELSKPYPWGAFYKGYNADGELVMSDGKLLASQIVGILVIIGWVIGMMVPFFGIFQFFGALRIPPEEEEMGLDRSKHGGSAYNGTGANTLGGLSPGNDVMRNNSPLGKVLPVTA

SEQ ID NO: 10074 - protein, 365 aa, Buchnera aphidicola (Macrosiphoniella ludovicianae)
  unsure (1)..(365): unsure at all Xaa locations
MKKQYRIAVLPGDGIGPEVMKEAYKILKILQNYFSLHIEIKEFNIGGIALDKEGVALPKDTLLGCENSDAILFGSVGGKKWNNLPIEKRPERASLLPLRKHFNLFYNLRPAKLYSELRFLSPLRSKTXIKNGFDILCIRELTGGIYFGEPRGRLKKNNIEYAFDTEVYYDYEINRIAHVAFQLARTRKNKVCSIDKANVLNSSLLWREIVTKVSKNYPDVHLSHLYIDNATMQIIQNPNQFDILLCSNLFGDILSDECAIITGSIGMLPSASLNEKNFGLYEPAGGSAPDIAGKNIANPIAQILSLSMLVRYGMNLKKIANKIDQSVISVLKKGYRTFDISDDNNXFLKTNEMGDVIADALINGE

SEQ ID NO: 10075 - protein, 434 aa, Vibrio parahaemolyticus RIMD 2210633
MKFPGQRKSKHYFPTHARDPLVNQIRQAPKLYRPTIVGVGQTIVDIEARVDDAFLEKYNLSKGHSLVLEESKADALYEELVEQGLITHQYPGDTIGNTLHNYSVLADSKSVLLGVMSKNIQVGSFAYRYLCRTSSRMNLNHLQTVDGPIGRCYTLISQDGERTFAINEGHMNQLLPESIPEEVFEKASALVVSSYLMRGKEEDPMPKAVQRAIDFAKKHDVPVVLTLGTKYVIEGNAEWWQEYIRENVSVVAMNEEEGAALTGEHDPLAAADKALEWVDLVLCTAGPNGLYMAGYTDEKVKRETTHDILESSIEEFNKFEFSRAMRKEDCVNPMKVYSHIGPYLGGPLEIKNTNGAGDAALSALLHDMAANSFHQKEVPTSEKHEVRCLTYSSLSQICKYANRVSYEVLTQHSPRLSRALPEREDSLEETYWDR

SEQ ID NO: 10076 - protein, 368 aa, Brassica napus
MFKQESNNNICNRENNRGARACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 10077 - protein, 418 aa, Glycine max
MSTTTVSGGDPPSRGFDTPTLDREAAALLHAISEHGGYAYVSMAVLASGGDIRAAEAAWEMAWEQLHSGPWHSVLPVWRDAYSMACLHVARHHYRNGEFWDALRVLDLGIIMGGTLLRKDLDSAIEKISEQTRKSVRVSDLGNSEHRLVDREFDMAEQITIPLLQSLLLKSLSNKLVAKKSALSLEKFLKDHYLSGCPVIISDCMAHWPAKMKWNDEDYLLRVAGDRTVPVEVGKNYLCTEWKQELITFSEFLQRIKSDSCSPGGPTYLAQHPLFDQINELRKDIFIPDYCFTGGGELRSLNAWFGPAGTVTPLHHDPHHNILAQVVGKKYIRLYSSSLSEELSPHSGTMLHNSSQVDLDDIDENKFPKVQDLEFVDCILEEGEMLYIPPKWWHYVRSLTTSFSVSFWWSEGESSDAS

SEQ ID NO: 10078 - protein, 340 aa, Lactococcus lactis subsp. cremoris
MAINLDWENLGFSYRNLPFRYIARFKDGKWSAGELTGDNQLHISESSPALHYGQQGFEGLKAYRTKDGSIQLFRPDQNAARLQKTARRLCMAEVSTEMFIDAVKQVVKANKDFVPPYGTGATLYLRPLLIGVGDVIGVKPADEYIFKVFAMPVGSYFKGGLAPSKFVISREYDRAAPLGTGGAKVGGNYAASLQAEVGAKASGYADAIYLDPSTHTKIEEVGAANFFGITADNEFITPLSPSILPSITKYSLLYLAEHRLGLKAIEGEVYAKDLGKFVEAGACGTAAIISPIGRIDDGEDSYIFHSETEVGPTVKRLYDELVGIQFGDVEAPEGWIVKVD

SEQ ID NO: 10079 - protein, 89 aa, Phaseolus vulgaris
DKKPSEQGAHINLKVKGQDGNEVFFRIKRSTQLKKLMNAYCDRQSVDFNSIAFLFDGRRLRAEQTPDELEMEDGDEIDAMLHQTGGSVF

SEQ ID NO: 10080 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKYFNLFSNLRPAKLYPELKCLSPLRSDIVKNGFDILCVRELTGGIYFGEPKGFVNKNNTKYAFDTEIYHEYEIIRIAHLAFKLARSKKKKVCSIDKSNVLRSSILWGKVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 10081 - protein, 413 aa, Actinobacillus pleuropneumoniae serovar 1 str. 4074
MALLPLSEALANMLARLPSPTKIENLPLNQCANRILAEDIFSPINVPSFDNSAMDGYAFRLADLVQFERLIVAGKSFAGNPFIGEVKAGECIRIMTGAMVPADCDVVVMQEEAEAETLASGQISVKFCKTPKLGQNIRRIGEDVKQGALVLAKGSLLNVTTLPLLASLGVAQVPVFSRLKVAILSTGDELTSVGQALEQGKIYDTNRFAVRLMLEKLNCDILDFGILPDDPAVFEQTFTQAQQQADVLITSGGVSVGEADFTKEVLDKLGEIGFWKIAMKPGKPFAFGKLQHAWFFGLPGNPVSALVTFYQLVQPALAKLAGVNAERIANLTQNLTAIADTNLKKAVGRQDFQRGFYYVNEQGEVAVRPVGLQGSHLFSAFYESNCFIVLEAERGNVDAGEKVTIQPFNSLLR

SEQ ID NO: 10082 - protein, 471 aa, Ralstonia metallidurans
MAQSVADVMKLVNENDVKFVDFRFTDTKGKEQHVSVPVSHFDEDKFESGHAFDGSSIAGWKGIEASDMLLMPDSGTAYIDPFYEEPTLVLSCDVIEPSDGKGYDRDPRSIAKRAEAYLKSTGLGDTAFFGPEPEFFIFDGVTWNIDMQGCSVKIQSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSIWKDGQNLFAGNGYAGLSEFALYYIGGIIKHARALNAITNPGTNSYKRLVPGFEAPVKLAYSARNRSASIRIPYVSNPKGRRIETRFPDPLMNPYLGFSALMMAGLDGVMNKIHPGEAADKNLYDLPPEEDAKIPTVCSSLDQALEYLDNDREFLTRGGVFSNSMLDAYIELKMEEVTRFRMTTHPIEFDMYYSL

SEQ ID NO: 10083 - protein, 147 aa, Eremothecium gossypii
MQLQINNIQCVASWYWDVPKELKRDSPVYEDEDEEDVCGICRGSYNGTCPNCKLPGETCPLIVGSCHHNFHVHCIYQWLNTSTSKGLCPMCRQAFSLREGIRINEPHRDKFEKVLMKARQQSVVSVAGANPVGPDQDDVIIDQEFIR

SEQ ID NO: 10084 - protein, 575 aa, Hydrilla verticillata
MEGNSNACGGVRDPYGEDCATEEQLVTPWTFSVASGYTLLRDPRHNKGLAFTEKERDAHYLRGLLPPVCITQERQEKKIMHNLRNYQVPLQRYMAMMDLQERNQRLFYKLLIDNVEELLPVVYTPTVGEACQKYGCIYRRPQGLYISLKEKGKILEVLKNWPEKNIQVIVVTDGERILGLGDLGTQGMGIPVGKLALYTALGGIRPSSCLPITIDVGTNNETLLNEEFYIGLRQKRATGKEYADLLHEFMISVKQNYGERVLVQFEDFANHNAFELLSKYSKTHLVFNDDIQGTASVVLAGVVAALKLVGGALAEHTFLFLGAGEAGTGIAELIALEISKQIKAPVEETRKKIWLVDSKGLIVSSRKESLQHFKKPWAHEHEPIKHLVDAVKTIKPTVLVGSSGVGRAFTKEVIEAMASFNEKPIILALSNPTSQSECTAEEAYTWTQGRAIFASGSPFDPVEYEGKTFVPGQANNAYIFPGFGLGLIIAGAIRVHDDMLIAASEALANQVSEENFEKGLIYPPFSNIRKISANIAANVAAKAYELGLASHLPRPANLVKYAESCMYSPVYRTYR

SEQ ID NO: 10085 - protein, 320 aa, Glycine max
  unsure (1)..(320): unsure at all Xaa locations
MSTAAAAGGDMEAGFAKLQGEDFEYYMQTYSIVLGRNSKKSTVDVDLSSLGGGMNISRHHARIFYDFARRRFALEVLGKNGCLVEGVLHLPGNPPVKLDSQDLLQIGDKEFYFLLPVRSILGGPVGPRHYPNHATPGPVVPHYNNYHLGPGPVKKXREREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTHEFVSLVSLLS

SEQ ID NO: 10086 - protein, 214 aa, Neurospora crassa
MANRQLARDMQVEFQARFNAKQARREAQKAAKQDNELKKQIQNLLKKGETAQAAQKARMLLAKQAIAQQMDQAADMAELSVAQIQANNAMNRMTFMMAQSSKTMSRAQRSVNPEKTLLTLEQYKQQNEEYAMSNGIYTDAMTQSTSVQVSDDAVHELLGKLADDAGLELGQELNKASASKVDPNAAAQQAVSQTAEPTPEEEDALQQRLRALRA

SEQ ID NO: 10087 - protein, 586 aa, GIBBERELLA ZEAE PH-1
MVLHQYDYIFALGTIFSFLDAWNIGANDVANSWATSVSSRSISYLQAMTLGSILEFAGSVGVGARVADTIRTKVVDLDQFESDPALLMLGMMCAIAASSIYLTFATRIGLPVSTTHSIMGGVIGMGVALVGAEGIHWAELDKGISSGVVSVFLAWIIAPGLSGAFAAIIFLITKYGVMLRSQPVWKGLFLTPVYFGITASLLTMLIVWKGGSIEITFTDAETVGMIIGVGAAWALIISIFLLPWLYRIVICDDWQLRWWHIIQGPLLLKRPPPPAQPDGAEGGIKDFYEGHMTKEELSELRRAGREGSDEFVRAQDQTSNEGKESSTENKVMTPPSEGTDDAAERVEPKPRRSLIGEKPEGRLFSGAVLFWYLKKAFLSGVDQDILAMQNKKSILTGDLDEIHSNVAHYDNRAEYLYTFMQVMTACTASFTHGANDVANAIGPYATIYQIWRTGTLDGSKSEVPVWILCFGGAGIALGIWTYGYNIMRNLGNRLTLHSPSRGFSMELGACITVILATRLKLPVSTTQCITGATVGVGLCSGTWRSINWRMVAWIYMGWMITLPVAGIISGCICGIIINAPRWGYSG

SEQ ID NO: 10088 - protein, 348 aa, Escherichia coli K12
MEFFKKTALAALVMGFSGAALALPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 10089 - protein, 213 aa, Malus x domestica
PIKAPILVEQGLFWDNEELISLLSKESEQNELQKPLQISPSLAGARREAVDWMLRVASHYSFSALSAVLAADYFDGFLSSLQLQVEKPWMTQLAAVACISLAAKVEETQVPLLLDFQVEDSKYVFEARTIKRMEILVLSTLQWKMNPVTPISFIDYITRRLGLKNHLCWEVLKRCELVLLSLISDSRFMSFLPSVVATAIMLHVVNNIEPCLL

SEQ ID NO: 10090 - protein, 1014 aa, GIBBERELLA ZEAE PH-1
MQLTGLRALLHSAVAASRSQARSRILCRSFQTTSTWRNTGAGAGANNGDKPPNQSTAVEDEEIQPQNGTENMPGRSRVRASSSLKSRTARKQAAPALPPVKLPQEFLNDNVTLHHARTRPQLPIALAEDAKQPKTSSIFIDPQAADKNTRVSESNKALEDYFDTTFSALVEKVADRAKEITAIEPNSCETDDLVHKLTNFTRAYDMLLDSAWHLTDSLYPARHPEYTYASRPFWWWHYYKDFDRHTQEFRDQFLSVQTGLDSILDYDWRLDHSLSQAIADLPVLTFSSVRSALRRELTTPPPPDSESKNLKRQITVLSMSGYSGQAISTAVAEHVAYFNDADLIKLDAQDLSVVVGDYLEQDWAYSRGSLSHMGFRAAEMNGKLYKDPDVVARPEEEDNDPDSGVINIRTASGGLEDELSKIKQGNYDPFGKWENLKIDKVLAQILEAAELKQGSTREKPLIIHIHDFVELNMTLEGSMLITRLRNLVDVAWRQGSKIAILGTSSSEQPSEEYQSMIRDISASDFVISRHIHPQRTLMQPKPSGGTQTSDNAFPLQETDIFVENVKNINRMLKALGSHEFLDFSDAHMKIFMHATDTRAQMLKKSILPLPEVYNIASAAKRHEEEAAGAAPGGVYERLLMGPLRQRPGQRYLDEPEQDGKADGEDSQKKAEDSQTGSRVALKLNEYEKRISSGHINRQNLRTTFEDVHVPKETITALKLLTTLALVRPDAFSYGVLAQDKIPGCLLYGPPGTGKTLLAKAVAKESGANMLEISGATINDKWVGESEKLIRAVFTLAKKISPCVVFIDEADSLLANRSMLGARASHRSHINQFLKEWDGLEETEAFIMVATNRPFDLDDAVLRRLPRRLLIDLPMQPDRTAILKILLKGETLEPNVSLEELAKRTPYYSGSDLKNACVAAAMAAVEEENEAAARHTGTEPYEYPKKRILRQDHFDKALRQIPASISEDMQSLKQIRKFDEEYGAKKKGAKKMMGFGVGAEKKLADADEVRIRRGP

SEQ ID NO: 10091 - protein, 446 aa, Staphylococcus epidermidis ATCC 12228
MPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 10092 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 10093 - protein, 354 aa, Brucella melitensis 16M
MARITLRQLLDHAAEKGYGVPAFNINNMEQALAIMEAANAVDAPVILQASRGARSYANDIMLRHMMDAVTEIYPHIPVCVHLDHGNEAATCMSAIQAGFTSVMMDGSLKADGKTPADWDYNVSVTRQVSEMSHLGGISVEGELGVLGSLETGMGDVEDAHGAEGKLSHDQLLTDPDEAVKFVRETKVDALAIAMGTSHGAYKFSRKPDGSVLAMHVIEEIHRKLPNTHLVMHGSSSVPEELQEIINKYGGQMKPTWGVPVEEIQRGIKHGVRKINIDTDNRMAMTGQIRRILQEEPSEFDPRKYLKPAMAAMTKLCKERFEQFGTAGHAASIRPIPLSEMAKRYRDGSLDPKFS

SEQ ID NO: 10094 - protein, 207 aa, Oryza sativa
MAAAAAAKIAPSMLSSDFANLAAEADRMVRLGADWLHMDIMDDLVRDGHFVPNLTIGAPVIQSLRKHTKAYLDCHLMVTNPSDYVEPLAKAGASDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGE

SEQ ID NO: 10095 - protein, 392 aa, Zea mays
MALRASPVSHGTAAAPLPPFARRRMARGVVVAMASTINRVKTVKEPYTPPREVHRQITHSLPPQKREIFDSLQPWAKDNLLNLLKPVGKSWQPQDFLPEPSSDGFYDEVKELRERANEIPDEYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFVSHGNTARHAKEYGDLKLAQICGTIAADEKRHETAYTKIVEKLFEMDPDYTVLAFADMMRKKITMPAHLMYDGKDDNLFEHFSAVAQRLGVYTAKDYADILEFLVQRWKVAELTGLSGEGRRAQDFVCTLAPRIRRLDDRAQARAKQAPVIPFSWVYDRKVQL

SEQ ID NO: 10096 - protein, 138 aa, Triticum aestivum
  unsure (1)..(138): unsure at all Xaa locations
DITNDSPIVGLAAGGLVHAADRTPQASTAGAKNRPRPRCTPGSGEALLRGQVKTLLQKVDEEGAAAAVIRPVRIHALLGVTRSPAXVLAPTPFNTPQLWADPPPVXSALPDGRTVLPCVLEQXELIPKLQVPISVLTP

SEQ ID NO: 10097 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 10098 - protein, 524 aa, Glycine max
  unsure (1)..(524): unsure at all Xaa locations
GNQDSNEPVDEALLSSVTKQKVAATKQYIENHYKEQMKNLQERKERRTILEKKLADADVSEEDQNNLLKFLEKKETEYMRLQRHKMGVDDFELLTMIGKGAFGEVRVCREKTSDHVYAMKKLKKSEMLRRGQVEHVKAERNLLAEVDSNCIVKLYCSFQDDEHLYLIMEYLPGGDMMTLLMRKDILTEDEARFYVGETVLAIESIHKHNYIHRDIKPDNLLLDRXARVKLSDFGLCKPLDCSTLEENDFSVGQNVNGSTQSSTPKRSQQEQLQHWQINRRTLAYSTVGTPDYIAPEVLLKKGYGMECDWWSLGAIMYEMLVGYPPFYSDDPMLTCRKIVNWKTYLKFPEEARLSPEAKDLISKLLCNVNQRLGSKGADEIKAHPFFKGVEWNKLYQMEAAFIPEVNDELDTQNFEKFDESDSQTQSSSRSGPWRKMLSSKKDLNFVGYTYKNFEIVNDYQVPGMAELKKKQSKPKRPTIKSLFETPEASDTSANDQPAQGSFLKLLPPQLEVSPHRDKNLPPRS

SEQ ID NO: 10099 - protein, 730 aa, Aspergillus niger
MRHFWLLPAVAGIAGAQCPYLSGEMSFTQEQDNAGDTIEVTEQPIDNTLYVNDTGSYMTTDFGTPISDQTSLKAGPRGPTLLEDFIFRQKLQRFDHERVPERVVHARGAGAYGTFKSYADWSNVTAADFLSANDKETPMFCRFSTVVGFRGSVDTARDVHGHACRFYTDEGNYDIVGINFAPFFIQDAIQFPDLVHAIKPMPNNEIPQAATAHTSAWDFFSQQSTALHSALWLMSGNGIPRSFRHMNGYGVHSFRFVAANGTSKVVRTPWKSQQGVASLVWDEAQAAAGKNSDYHRQDLYNAMPNGHYPKYELQAQIMDEADMLRFGFDLLDPTKLVPEEVVPYTPLGMMELNANPTNYFAEVEQAGFQPGHVVPGIDFTDDPLLQGRLFSYLDTQLTRHGGPNFEQIPVNRPRKPVHNNNRDGFGQQQIPTNNWAYTPNSMSNGYPMQANQTQGHGFFTAPYRYASGHLVRQTSPTFNDHWSQPAMFWNSLIPAEQQMVVNAIVFENSKVNSPHVRKNVVNQLNMVNNNLAVRVARGLGLDEPSPNPTYYTSNKTSNVGTFGKPLLSIEGLQVGFLASNSHPESIKQGQAMAAQFSAAGVDLNIVTEAYADGVNTTYALSDAIDFDALIIADGVQSLFASPALANQMNSTATSTLYPPARPFQILVDSFRYGKPVAAVGSGSVALKNAGIDSSRSGVYTGSSETTEKIAKEVLEGLYTFRFVDRFALDE

SEQ ID NO: 10100 - protein, 280 aa, Magnetospirillum magnetotacticum
MWTRPWRIARSPEPAAAPAPSAPLPNKGDTAWMLLSSVLVLLMTVPGLALFYGGLVRTKNMLSVLTQVFAIASIVCLLWVAYGYSLAFTNGGGLNDFVGGFSKAFLKGVDANSVAATFSNGVVIPEYVYICFQMTFAMITPGLIVGAFAERMKFSALIVFSILWVTLIYFPMAHMVWYWGGPDVFADAARKLAAAGGEANAAAKAEYDAVLGDAGLLFKWGALDFAGGTVVHINAGIAGLVGCLMLGKRIGYGRDLLAPHSLTMTTIGASLLWVGWFGLQ

SEQ ID NO: 10101 - protein, 252 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 10102 - protein, 160 aa, Zea mays
  unsure (1)..(160): unsure at all Xaa locations
MAAAAAAPASVVPSPSPAPKAAGDSRKTVVPVDASELEKHVLAVDDSSXVDRAVIARILRXSRYKVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 10103 - protein, 106 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGL

SEQ ID NO: 10104 - protein, 914 aa, Magnaporthe grisea
MDGHSNFTQPSDTSHASHTIPSSSSSQRRRLTKKPPPSTSARHHHSSLSIDSRVDAQSLVGKRSSTSLRRAPSAPPARTPTSTHASNSSSPRNPSSSTRLNNHSPIIPAASEFAASSLSPSARDRDSDPARNDHGHQLQNNNNYYYSAFTNAHHHNQYSAASHRRSNSYGHPHGPQSSNSLTFNHSEDFIGAPFDGSAILNRIEATKASPTLGSGAFPHISNPIPVGAAAPAQYSRGSPALEQSFTFPSAAMREKSQQVRGMEAQLPTSKRYSDETKEPKPGVLRKKSGFSGFMSGLVGTPKKPLISAPENPVHVTHVGYDSATGQFTGLPKEWQRLISESGITEKERRENPETLVNVIKFYKETTEKPAEDQVLEKFHDARPGLPSAPSAGSMISPGLAPHHYNPMSPMISPPASPRFPQVGHEGNFENPRSPPPVPKNKDVTLMPSRPAPRPPVSLPTRTAPHAPYAAKDSGIDMPPQHDDLTPTTYQPPKESQPILPEEHRSRSNSRVNGNTAYPASQQSPAVQAAYQQQLMQQQQEQALAQAQASMSGSMSRAPSKRQPQAQQPTPPQSQHQYSRPTDANGAQQTQRPQQPQIGPVPQSRPRHRSRQSNGLDVVAALKRICSEGDPREIYRSFTKIGQGASGGVYTGHERGSNRLVAIKQMNLEQQPKKDLIINEILVMKDSSHPNIVNFIDSYLCGGELWVVMEFMEGGSLTDVVTFNIMTEGQIASVCRETLLGLQHLHSKGVIHRDIKSDNILLSMEGNIKLTDFGFCATINEAQNKRTTMVGTPYWMAPEVVTRKEYGRKVDIWSLGIMAIEMIEGEPPYLTESPLRALWLIATNGTPQIKDEGNMSPVFRDFLYFALKVDPDKRASAHDLLRHEFMNLCVDLSHLSPLVRAAREARAQEKARKGQ

SEQ ID NO: 10105 - protein, 180 aa, Triticum aestivum
  unsure (1)..(180): unsure at all Xaa locations
MAPTXMAXSAXSVXPFQGXKSXAXLPXXRRSNGASLGSVSNGGRIRCMQVWPIEGIKKFETLSXLPPLNTEALLKQVDYLIRSKWVPCLEFNXVGFIFREHNASPGXYDGRYWTMWKLPMFGCTDXHTXVXNXVXGGXKKEXPRRYRNQSGFNAPKCKCVLSILQNQPGLRRIPKGKLHS

SEQ ID NO: 10106 - protein, 386 aa, Zea mays
  unsure (1)..(386): unsure at all Xaa locations
MSPTEEAAGGGLDDYDRLSELKAFDDSKAGVKGLVDAGVTTIPAIFRGHLLQEGPKVSSSSSSSSTSLSIIPVIDLSAADAVAREEVVAQLKAAAETVGFFQLVNHGVPSELLSEMLASVRRFNEEPHEVKRPYYTRDARRKVRFNSNFDLFQSPAANWRDTLFCEAAPEPPRAEELPVAVRHVMLEYGGAVREVAARVLGLLSEALGLSPGHLAGMGCAEGLSLVCKCAXYYPPCPEPDLTLGCSRHSDPSFLTVLLQDSHAQGGLQALLASRWLDVPPVAGALLVNVGDLLQLVSNGRFKSVEHRVVANRSRDTARVSVACFCNADIARSTRLYGPIAELIAADDSDGAGRALYRNVTVPEFLAHYDKKGLDGRPALHRFQLLQ

SEQ ID NO: 10107 - protein, 176 aa, Eremothecium gossypii
MDANSDQRDKHNQYIAELREQDRWLPINNVARLMKNTLPVTTKVSKDAKECMQECVSEFISFVTSEASDRCASDKRKTINGEDVLISLHALGFENYAEVLKIYLAKYRQQQALKNQMIFQRREDGADGLDGAADDGSDDAGEEEGEHGAGAAAGAPGAGALPEQDQFINQDGSLYI

SEQ ID NO: 10108 - protein, 253 aa, Oryza sativa; identical to SEQ ID NO: 7171

SEQ ID NO: 10109 - protein, 74 aa, Zea mays
  unsure (1)..(74): unsure at all Xaa locations
TTQRGGLFIEILPQTLPNHSPKTQQLLFYITNLDQKTTLXHFPLIEASNXCNMHIFSKDQHIICLSFHYSKLLI

SEQ ID NO: 10110 - protein, 244 aa, Zea mays
RRPNRGWGRGRCSSPAGPPGCTSPRPSPRRSSRAPGRARTCRARAGAWGWSRPATAPCSGTPSPPRPRAGTAAPPSPCSSAPAPPPRAPSAAAAAPASVAPSSPKAAGDNRKTVVSVDASELEKHVLAVDDSSVDRAVIARILRGSRYKVTAVESATRALELLALGLLPDVSMIITDYWMPGMTGYELLKRVKESAALRGIPVVIMSSENVSTRITRYLEEGAEGFLLKPVRPADVSRLCSRIR

SEQ ID NO: 10111 - protein, 266 aa, Rhodobacter sphaeroides
MTLVDRPLIQYAIDEARAAGIKEFIFVTSRGKSALEDYFDNAPELEAALKKPGKEHLLDVLESTNMESGAIAYVRQHKALGLGHAVWCARRLIGDEPFAVMLPDDVIAAEKPCLQQMVEAYEQTGGNMVAAMEVPPEKASAYGVLSVAEDMGSIVKVNGMVEKPKENPPSNLAVIGRYILTPQVLNNLNRKKEGAGGEIQLTDAIAEEIDESGKVYGFRFRGQRYDCGSKAGFLQATVAFGLARPELRDEFSGYLHDMLALEKAAQ

SEQ ID NO: 10112 - protein, 135 aa, Glycine max
MLMNSASGGDAPSRGFDTPTLDLVSTALLHAIFEHGGYTCVSMATLAENGDIRTAEAVCKRAWEQLHSGPWHSVLSVWREAYSMACLLVARHHYHNGEFKDVLRVLDLGIIMGGTLLRKDLDSAIEKISEQTRKS

SEQ ID NO: 10113 - protein, 301 aa, Oenococcus oeni MCW
MKVGMIGLGKMGLNLVKNMIDNKIEVVGFDLNSDSIDKAASYGAQTAVDTQDLVDKLDSPRIVWVMVPAGKPTNSTIDDLIEKLDAGNILIDGGNSNYKDNLEQNKRTTAAGIKFFDAGTSGGMEGALEGGNFMVGGDDPEAWKTIEPLFKAISVKDGYLYTGKLGSGHYLKMVHNGIEYGEMQAIAEGFEVLEGSQFDYDYEAVAKLWNHGSVIRGWLMELAEDAFSKDPKLDQIAGRMHSSGEGKWTLEEAMNMRIPTPVIALSLMMRYRSMQDDTFTGKVVAALRHEFGGHAVDKCDN

SEQ ID NO: 10114 - protein, 440 aa, Streptomyces coelicolor A3(2)
MSTPPPPRTLSSGTRPPGTAEDPTEEGPFGWLRALGPRGRRAFGGAFGGYALDSYDYFTLPLTMVALAAYFGLDSGQTGLLTTVTLVVSAIGGALAGVLADRVGRVRALLLTVITYAVFTVACGFAPNYETLLVFRALQGLGFGGEWAVGAILVAEYASPGHRGRTLGAIQSSWAVGWALAVVVYTLVFSLAGDDLAWRVMFWTGALPALLVVWVRRSVQDAPRAAEAREKGTGRGSFAAIFKPGTADSPGLLRVTLFASLLSTGVQGGYYTLATWVPTYLKDERDLSVVGTGGYLTFLISGAFLGYLTGGVLTDVLGRRRNIWLFALLSAVCILAYANIPRGADTLLLVLGFPLGFCMSAIFSGFGSYLSELYPTAVRGAGQGFTYNTGRAVGAVFPTTVGFLADSWGVGGALVFGAIGYGIAALALLGLPETRGRELA

SEQ ID NO: 10115 - protein, 395 aa, Neurospora crassa
MTFEEPSKYDALPTYRAVDQHGQVVDPSFKPDLSDKEVIKLYHDMLTVSIMDLIMFDAQRQGRLSFYMVSAGEEAVCVGSASALSPEDVVFCQYREQGVFKQRGFQLSDFMNQLFANHKDSGKGRNMPVHYGSKELNIHTISSPLATQLPQAAGAAYALKIQRMQNPTVPPRVVAAYFGEGAASEGDFHAALNIAATRGCPAVFICRNNGYAISTPTLEQYRGDGIASRGLGYGIETIRVDGNDFWAVREVTKRARELALQDGGKPVLIEAMTYRVSHHSTSDDSFAYRAKVEVEDWKRRDNPIGRLRKWMEAKGIWDENMEREARDSIRRDILKAFSQAEKEKKPAIRTMFEDVYEEMTPEIKAQMKELKEHLEQYPEEYDLGDFEGGKDSLAR

SEQ ID NO: 10116 - protein, 342 aa, Oryza sativa
MAGIRWPPEDPEIFPSRMVTGGGGGGAGGGPPGPPGEMASDDDRSVAADSWSIKSDYGSTLDDEQRYADAAEVLLASSSSSSAAASGPAAATTASVAANPSGDFSFDKDVPDSADMEPPLLGLPNYHQDGSYAEYLANFQERSHTDDWFGTENMDVLVSWTKNLCSNKDLRSCSVLDIGTGSGRLSQQLAKQGFSDLTGIDHSEGAIEVARNLAIRDGFEHINFLVDDVLESKLERRFELVMDEGTLDTIGLHPDGPVKRMMYWQSVAGLVSPGGILVITSCSRTKDELVQEVESFNQRKLSAMGSEGAQASDTAVFKYIDHVQTYPIVDSSCITTVAFSHS

SEQ ID NO: 10117 - protein, 638 aa, Agrobacterium tumefaciens str. C58
MMTSSNSTVPDSRSETKKFLVLLLGSIGVVYGDIGTSPLYAFRESLRPFTANGVQHEHVVGLISLMIWTLTIIVTFKYVLFLLRADNDGEGGTLSLLALLMKKTGSYMPVLFFAGLIGSALFIGDAMITPALSVMSALEGMKLVTPAFSDYVLPLSALIMVGLFAVQSKGTGAVAVFFGPITVVWFLAMAWGGLIHIGDDWTILEAVNPINALWFITHAGWAGLIVLGAVFLTVTGAEALYADLGHFGRKPISVAWFILVFPALALNYLGQGALVLSNPAAIENPFYLLYPEWALFPMIILATMATVIASQAVITGAFSLARQAVHLGFLPKLMIRFTSETNTGQIYVPAVNMVLFIGVLVLIFSFGDSESLATAYGISVTGAMVVTTLMAFQFLRSIRGKSAFTAAILLAPLFSIEAVFLAANLLKVHDGGWVPLALAGVIILVMWTWTKGSRYLREKISKNDVSLDTFITSLERSISRESRSAPVLVSGTAVFLTSVPDKAPSVLLHNLKHNHVLHEQNVILTIWTHDKPYVADTDRVEITRISKHFMRLDINFGFMDDPNVVKALPLCKKKGFKFEIMQTSFYLGRRNLIATPNTGLPRWQEDLYIALADFGVDPSAYFKLPPNRVIEIGEQVAI

SEQ ID NO: 10118 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWASGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 10119 - protein, 366 aa, Oryza sativa (japonica cultivar-group)
MAQRVQEEDEQMTSTDDLIQAEIELYHHCFAFIKSTALRAATDLCISDAIHRNGGAATLSDLALNIGLHPTKLSHLRRLMRVPTVSGVFAVEDHNGEAMYTLTRVSRLLLNGDGERTHALSHLVRVLVNPLTVASHFSIHEWFTIEQAAAMTPFEVAHGCTRWEIIANDAKDGSVFNTAMVEDSRVAMDIILKESCGVFQGISSLVDVGGGHGAAAAAIATAFPNIKCTVLDLPHIVAEAPTTHSNIQFVGGDFFEFIPAADVVLLKYILHAWQDDDCVKILRRCKEAILARDAGGKVIIIEVVVGIGPKEIVPKEMQILFDVFMMYVDGIEREEHEWKKIFLEAGFSDYKITPVLGARSIIEVYP

SEQ ID NO: 10120 - protein, 132 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 10121 - protein, 528 aa, Lactobacillus plantarum WCFS1
MMVSSFILVLAAVVSIFISRVMPQISVNYLSLIVGIGLFFIPVLSNHIENFNSEIFIGLIVAPLLFFEGQATRLNAVGKELKHIIQTTVGLVILALIVAGFSLAGLGLVGLPLAFILAAISTPTDATAMESVTNGLEMPSTEGTFLKMESLFNDASGIILLNMAVLWYANGYINYGQTIIDFIISAVGGVLFGFVSAWIMVLFRQVLLRSSYNSLNASLLMYVITPFILYYAAEAIHVSGIITVVVAGLVHNAEAQRSRLINAQQVHFAFDLVSMITEIFNSMVFVVLGFMFIKILVNEQFGHGSLNFLLIGLVLYISNVLVRYSYGRLRLSFKNRPAWIFALGGVHGAVTLALAYTLTDTAVGRGDFNLVLMAASTLIILSMVVPTIIFRWLLKPALTDDEATSEIDQIRVAMVHHAIDTVQKMYLPPNVKESVIFDLMTQKQRTRTRDFARAWVDVVRRPEFTGAEKELEMRAFMNALEQERQYLDMISQREVKYQKYVFKLYNETLLAESLVIGPTIFDKDKATE

SEQ ID NO: 10122 - protein, 460 aa, Pseudomonas aeruginosa PAO1
MKIKESPGAFHAASGTLRNVCRRKAAVRTTTTASSWCVEGRAWAFLVLSLYARRLPQSMDNLNSAVQVLIHGSNTLFILLGAVMVLAMHAGFAFLEVGTVRLKNQVNALSKILSDFAISALAYFFVGYWIAYGVTFFHPAAALTVDSGYALVKFFFLLTFAAAIPAIISGGIAERARFGPQLCATALIVAFVYPFFEGLVWNGNFGLQEWLKLEFGAPFHDFAGSVVVHALGGWLALAAVLLLGSRNGRYRDGKLVAMAPSSIPFLALGSWILIIGWFGFNVMSAQTLAGVSGLVAVNSLLAMVGGTMASLLIGRNDPGFLHNGPLAGLVAVCAGSDLMHPIGALATGLVAGALFVWAFTATQVRWKIDDVLGVWPLHGLCGVWGGIACGIFGQQALGGLGGVSLASQALGSLLGVTVAFAGGLLVYGLMKALLGIRLSQEEEYYGADLSIHKIGAISHE

SEQ ID NO: 10123 - protein, 496 aa, Caulobacter crescentus CB15
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 10124 - protein, 220 aa, Glycine max
  unsure (1)..(220): unsure at all Xaa locations
ARNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNNNAILYKPDEHPHHIIIIKYIPYLRNSDTAINKYTSXIFIAKKITIIYHNTYENSLLPTPIILNLLLLTQLITRIXFKSQYEXKCHSFHPGTTILHYLTKSALVPP

SEQ ID NO: 10125 - protein, 285 aa, Bradyrhizobium japonicum USDA 110
MWPRAAVGGPAMQMNDKTVLITGSTDGVGRYVARRLAAECAKVLIHGRDAARAKTLIDEIVKAGHAAPIFYQADLSSMSGTRALAEAVKRDHQRLDVFVSNAGIGSQSDGPQRQVSADGHELRFAVNYLSGFLLAHLLLPLLKAAAPSRIVNVASLGQHPIDFDDVMITKGYSGSRAYAQSKLAQIMFTIDFAEEVKGAGVTVNSLHPATYMNTTMVRAGGITPISTVEQGGAAILRLVEGDDVAGKSGLFFNGINEARANPQAYDADARKRLRALSLELVGISS

SEQ ID NO: 10126 - protein, 310 aa, Escherichia coli K12
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 10127 - protein, 217 aa, Caulobacter crescentus CB15
MQIFLDSTDTKVIADLASTGLIDGVTTNPTLIAKSGRPMLEVIAEICDIVPGPISAEVAATTADAMIAEGQKLAKIAPNVVVKIPLTRDGLIACAAFADEEIKTNVTLCFSPTQALLAAKAGATYISPFIGRLDDYGFDGMDLIRDIRAIYDNYGYETEILAASVRNAAHVKEAAIVGADVVTIPPAVFSDLYKHPLTDKGLEQFLKDWASTGQSIL

SEQ ID NO: 10128 - protein, 271 aa, Zea mays
MAYAARLVAKVHLAATPQAEPRHLSSFRVGALSRSTTVQRQKFVAKSAISAVESGDTFVGVKQNTRPIIVIDNYDSFTYNLCQYMGEVGANFEVYRNDEITVEEIKKLISPRGILISPGPGTPQDSGISLQTVTELGPSIPLFGVCMGLQCIGEAFGGKVVRSPYGVVHGKGSLVHYDEKLDGTLFYDIPNPFQAGRYHSLVIEKDSFPHDTLEIVAWTDDGLIMAARHRIYKHIQGVQFHPESIITTEGRLMVNNFIKIIEGYEASNCSP

SEQ ID NO: 10129 - protein, 344 aa, Corynebacterium efficiens YS-314
MPIATPEVYNEMLDRAKEGGFAFPAINCTSSETINAALKGFAEAESDGIIQFSTGGAEFGSGLAVKNKVKGAVALAAFAHEAAKSYGINVALHTDHCQKEVLDEFVRPLLAISQERVDRGELPLFQSHMWDGSAVPIDENLSIAQELLAKSKAANIILEIEIGVVGGEEDGVEAKAGANLYTTPEDFEKTIDALGTGENGRYLLAATFGNVHGVYKPGNVKLRPEILLEGQQVARKKLGLADDALPFDFVFHGGSGSEKEKIEEALRYGVIKMNVDTDTQYAFTRPIASHMFENYDGVLKIDGEVGNKKAYDPRSYLKKAEQSMSERVIESCQDLHSVGKTTAK

SEQ ID NO: 10130 - protein, 778 aa, Zea mays
MPRKASSNSDARAKSRKRKRAAASASPSKQPDDHSDDSDTAAAANGDDETSRAASVNGGGGTLAGVGGDDDPVLDLRAAEVLSSSAEPVSAFPAAVRRAVSRPHPSVLAVIAAERAAASSDDAPVTPASVPVLENISHGQLQVISAMLPDHPSLSYDPDKPSTYVCTPPPLMEGCGVHKQFYDKLHIVPRHSDWFVPQTVHRLERQVVPQYFSGKSQGQTPEKYIMLRNKVIAKYLERPGKRLVFAECQGLVTSTPELYDLSRIVRFLESWGIINYLATGSVYRGPRTASSLIKEETTGELQLVSAPMKSIDGLILFDRPKCSIQANDISSLVSTSSAPFVVNHDGDSANLDEKIWERLSESLCSYCSQLSHASDYESQKETDIALCSDCFHNAKFVTGHSNLDFQRVDAMKDGSDTDGDRWTDQETLLLLEGIEKFNDNWNHIAGHVGTKSKAQCIHHFIRLPVADGLLENIEVPEASVSSGMQSSGFLYSDSNGGISGSVPQSSQPGQQLPFVNSANPVMSLVAFLASAVGPRIAASCANAALSVLTRDDSRMCSEGNDVMGQAARPNYDASSSVSPENVKYAAMCGLSAAATKCKLFADQEEREIQRLSATIINHQLKRLELKLKQFAEVETMLLKESERLDLMRQQLVTQRIRMLSTRFTSTGGTIPGGSSGMVSNLMNQASGLRPPLMMPGSVTQSSMPAMYANNMQGHPQMALLQQRQQMLSFGPRLPLSAINPGSSSSAPNMMFNHGMPNSAAPNHHPLLRSPSGDNSNVG

SEQ ID NO: 10131 - protein, 171 aa, Triticum aestivum
  unsure (1)..(171): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYXGRYWXTMWKLPMFGCTDATXVINEXEESRKEYLTPXVRIIGFTTSSVXCVSSSPARAQDPQG

SEQ ID NO: 10132 - protein, 451 aa, Zea mays
MASGRESFSHLLPAQSPATRPPVLSSSARAKSSAPHPEAPCSAPEIPPMAGVRSLRSSDRTPWPSRLPFPHAQEFTSVRSARSLPPSSAAHLHGQSSFISLLSASSPCSRSAPPMAGIPFLPSSHGGAHPLLPPVLPTTPTAGLCARALLPCRAPRPAVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 10133 - protein, 414 aa, Neurospora crassa
MTDNKRVAKDIMSGLLLAATTISVYFIFRDYVAPHVAKLIDPDRAKHDQNRLKAQQNLARIQKSRDKSKVANDEFADDEVPEDSPSTVRVEDLILNEYESQVALEVVAPEDIPVGFDDIGGLDEIIEEVREAIIYPLTMPQLYSHGGTLLSAPSGVLLYGPPGCGKTMLAKAVAHESGASFINLHISTLTEKWYGDSNKLVRAVFSLALKLQPAIIFIDEIDAVLGTRRSGEHEASGMVKAEFMTLWDGLTSTNSLGQPARIMVLGATNRINDIDDAILRRMPKKFPVPLPGKDQRRRILELVLADTKRDPEFDLEYIAMVTEGMSGSELKEACRDAAMVPMREAIRNQKAAGKSIKKLDPNTVRGLRTNDFFGRKGGAPSLAADSRPSSVRPEAAMSEREIYEVETETEDVLS

SEQ ID NO: 10134 - protein, 312 aa, Triticum aestivum
  unsure (1)..(312): unsure at all Xaa locations
GRSRRSQYPRVXAKEGLPWXSKGKTDKDGCYPPGHGDIFPSLMNSGKLDLLLSQGKEYVFIANSDNLGAIVDMKILNHLVHKQNEYCMEVTPKTLADVKGGTLISYEGRVQLLEIAQVPDAHVNEFKSIEKFKIFNTNNLWVSLKAIKRLVEADALKMEIIPNPKEVEGVKVLQLETAAGAAIRFFDHAIGMNVPRSRFLPVKATSDLQLVQSDLYTLVDGFVTRNAARTNPSNPSIELGPEFKKVGCFLGRFKSIPSIVELESLKVSGDVWFGSGIVLKGKVTITAKPGVKLEIPDGKVIENKDINGPEDL

SEQ ID NO: 10135 - protein, 316 aa, Buchnera aphidicola str. APS (Acyrthosiphon pisum)
MNQLSALKQFSIIVADTSDIKSICKYQPEDATTNPSLILQAVSSNTNQNFVDQAVQYAKKKGGLYKDQIINASDKILVDLGIEILKKIPGYISSEVDARLSFSTEASILKAKKIIDLYEEQGISRNRVLIKLAATWECIKAAEELKKDSILCNLTLLFSFAQARACAESNVFLISPFVGRIYDWYISQNLLSKSFLGKDPGVISVCKIYEYYKKYGYKTIIMGASFRNIQQILYLSGCDRLTISPVLLKELESNTAKIDRNLAPPSFISVPPVALSEEEFRWEHNQDAMAVQKLSDGIRNFGKDQLRLEKIFSKKI

SEQ ID NO: 10136 - protein, 257 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDLRKFQKSLFCTPIKA

SEQ ID NO: 10137 - protein, 549 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSTTVTNDNH

SEQ ID NO: 10138 - protein, 123 aa, Zea mays
MDTIGPHVLIVDDTFVDRLVASRVLKTCNIQVTMVEGPKQALDFLDVENDVNLILTDYCMPGMTGYDLLMEVKESPKLKHIPVVVMSSDHIPQRMQKCMDAGAKEYIIKPIKAIDVPRILSYI

SEQ ID NO: 10139 - protein, 370 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASRKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 10140 - protein, 313 aa, Glycine max
  unsure (1)..(313): unsure at all Xaa locations
CSYGCEKTTEGYPIVQVTHLAGVLGFGGFCFLLGARPQDIPYVYCLFYVIFVPLRWIYYRSKKWHYYLLDFCYYANTIFLIDLLFYSSNEKLFLVCFSFAEGPLAWALIVWRCSLVFSSVDKIVSVLIHLLPELVFFTIRWWNPATFEAMRPAGMAGRSTWPYIEDKSYLWMWLFLVPLAVYILWQVLYFLIVNVLRQQRFLRDPEAMTSYRELSKKAQKANXIWWRLNGLLGDQNRMLMYIFLQGIFTVATMALTVPIFLSYELHVVFQILKVSASIWNGGSFLLEVMPRQVILKEKKKSEMQPVEEATIIE

SEQ ID NO: 10141 - protein, 158 aa, Zea mays
MVSAKRLVQMAKKWQRMAATARRRIALAPPAKGAAEGSSPPCSTSRVAVAGKGHCVVYSADGRRFEVPLPYLDTAVFGVLLGMSREEFGFAGGDGRITVPCDAAVMEYVMCLLRRDASEEVVRAFLSSVVSRPCSHCGNGSLVQSTTGVRQQAAVSSF

SEQ ID NO: 10142 - protein, 515 aa, Burkholderia fungorum
MPVTITILAVKCGAEPSAGCSQYLGNIGHGKISGSAGPDHKSDRVIDIHTLGRNLNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 10143 - protein, 592 aa, Triticum aestivum
  unsure (1)..(592): unsure at all Xaa locations
AVSGRPRLGGGVAGAPCAAVLRPPARPPRLPPSEGQNWKGVTRFPFDAKVTEQDLADTYNPPFNSCVEDGGASGIMCSYNXRINGVPPGAXHNLLSTTARGRLGASTGYITSGLRAPWPIIHDVQGYAKAPEDAVADVLKAGMDVNCGGYIQTHGVSAYQQGKITGEDIDRALRNLFAIRMRLGLFNGNPKYNRYGNIGADQVCKKEHQDLALQAAQDGIVLLKNDAGALPLSKSKVSSVAVIGPNGNNASLLLGNYFGPPCISVTPFQALQGYVKDATFVQGCNAAVCNVSNIGEAVHAASGADYVVLFMGLDQNQEREEVDRLELGLPGMQESLVNKVADAAKKPVILVLLCGGPVDVTFAKNNPKIGAIVWAGYPGQAGGIAIAQVLFGEHNPGGRLPVTWYPKEFTAVPMTDMRMRADPSTGYPGRTYRFYKGKTVYNFGYGLSYSKYSHRFASKGTKPPSMRGIEGLKATASAAGTVSYDVDEMGAEACDRLRFPAVVRVQNHGPMDGRHPVLLFLRWPNATDGRPASQLIGFQSVHLRADEAAHVEFEVSPCKHFSRAAEDGRKVIDQGSHFVKVGDDEFELSFMA

SEQ ID NO: 10144 - protein, 218 aa, Triticum aestivum
MAAREQGGDEYDYLFKVVLIGDSGVGKSNLLSRFTKNTFSLDSKSTIGVEFATRTTQVEGKTIKAQIWDTAGQERYRAITSAYYRGAVGALLVYDVTKAATFDNVKRWLKELRDHADSNIVIMLIGNKTDLRHLRSVATDKAAGFAEWEGLSFIETSALDATNVDKAFQTVLAEIYRVVGKKALSSTDDSGAGAVGEGQSILVSGGEPTSVSSRCCSF

SEQ ID NO: 10145 - protein, 531 aa, Aspergillus parasiticus
MAVLHSGVVCLDGWFYLRLLHRYVNFPVGYLPCFVLTFTSGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLVVGALSSIVPMYQSESAPRQVRGAMVSAFQLFVASVFSSLISSTSVPNPSTVPLPGVSLWDMCAWPLILGVGTLFLPESPRYAYRNGRVEEAREVMCKLYGVGPNHRCIAQEMKDMKDKLDEEKAAGQAWHFEVFTGPRMFYRVAGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIGGFATTWGPIVWAICGEMYPARYRAVCIGLATAANWSLNFLISFFNPIHLQRYRLCYGYVFAGCCFAAVLVVFFFVNETQGRTLEEVDTMYVLHVKPWKSASWTPRRVSSVISTDPPLPPSRRVGLSTASPPPRSASKWYHV

SEQ ID NO: 10146 - protein, 336 aa, Coxiella burnetii RSA 493
MIRVITVDDIKSLIRKVTLEKFFSLLIEKLETTFSGWNEFEKMTRLVSHVENGVIELMPFWGKDYYSVKYINGHSLNPLDNKLTIVGLGMLADIATGYPVLISEMTLLTALRTAATSALASKYLAKSDSKTFAIVGTGAQAEFQVIAHKTLFEIENIKYFDIDPKALDKFEKNLSAYPFHLERARNVETAIKNADIITTATAIQKKTQILKNDWIQPGMTINAIGGDRAGKTELDPKILERGKVVVEFLEQSKEEGEIQNYNHSHVYAELWELIQKKKSGRTSTDEIFIFDSVGFALEDHAILRLVYSLAEDFQVGHMLDMVPEISDPKDLFGLLF

SEQ ID NO: 10147 - protein, 189 aa, Triticum aestivum
  unsure (1)..(189): unsure at all Xaa locations
ILLSKISPXLVGNPIEEQKLYDAVDCILYSMNKGGTFSSYECQRTTSWLEILNPSENFVNIVIDYPYVECTSSVLEAFILFKELYPLYRTQEIDECINNAAMFIENKQRKDGSWHGTWGICFTCGTMFAVKGLVAAGRTYDTSSSIRKACNFLLSKQQTTGGWGESYLSSETGKYSNGDTHAVNTAWAM

SEQ ID NO: 10148 - protein, 359 aa, Streptomyces avermitilis MA-4680
MSETSPKLRAELEGIPTYKPGKPAAAAGPVAYKLSSNENPYPPLPGVLESVASSVGSFNRYPDMACSGLMSELSERFGVPLSHLATGTGSVGVAQQLLQATSGPGDEVIYAWRSFEAYPIITQVSGATSVQVPLTPGDVHDLDAMADAITDRTRLIFVCNPNNPTGTVVRRAELERFLDRVPSDVLVVLDEAYREFIRDPEVPDGVAIYRERPNVCVLRTFSKAYGLAGLRVGFAIAHEPVAAALRKTAVPFGVSQLAQDAAVASLRAEDELLGRVGALVCERQRVVASLREQGWTVPETQANFVWLRLGERTLDFAAACEQAGVVVRPFAGEGVRVTVGENEANDIFLKVTERFRKEL

SEQ ID NO: 10149 - protein, 373 aa, Oryza sativa
MSTLVDALCAPCSDTALIYDTFNASAAASFLFDNAAAFCDADILGATATGEKEATSSAAAAAAEAAPPRKKRRRRAKSCKSREETETQRMTHIAVERNRRRQMNEYLAILRSLMPEPYVQRGDQASIVGGAIEFVKELEQQLQSLEAQKRTLLPHHKARCDDATPMHNASGSNVGAGGCMEPTTTTSNCSSSVTEDAPSADAPPFAQFFAYPQYVWCHSPRDSTTTTTAASASASASASSSSPATVAAALQSEHRSGLADIEVSLVETHASVRVMSPRRPGQLLKMIAGLQALRLTVLHLNVTTLDSLVLYTLSVKVEEGCSLTTVDDIAAAVHHVLCIVDAEAAASEHLLAAGQLATTATAVAKRELATYMY

SEQ ID NO: 10150 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEYCWLGDNTVSLLDLDTTKDVVKNEWYDWVGSLVSNYSIDGLRIDTVKHVQKDFWPGYNKAAGVYCIGEVLDVDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 10151 - protein, 239 aa, Bacillus amyloliquefaciens
MKRVLLILVTGLFMSLCGITSSVSAQTGGSFFEPFNSYNSGLWQKADGYSNGDMFNCTWRANNVSMTSLGEMRLALTSPSYNKFDCGENRSVQTYGYGLYEVRMKPAKNTGIVSSFFTYTGPTEGTPWDEIDIEFLGKDTTKVQFNYYTNGAGNHEKFADLGFDAANAYHTYAFDWQPNSIKWYVDGQLKHTATTQIPAAPGKIMMNLWNGTGVDDWLGSYNGVNPIYAHYDWMRYRKK

SEQ ID NO: 10152 - protein, 360 aa, Schizosaccharomyces pombe
MWRSIISFLFFSVALCQPFLFQKRSSNISDFISFNASLPNVTIFAMGGTIAGYASSSTETVDYAAGSVGIATLVDAVPAIKNFSNIRGVQVTNVGSEELTPANVLNLTQLILAEVAKPDVHGIVVTHGTDSLEETAMFLDMTVNTTKPIVVVGAMRPSTAISADGPMNLLNAVVVAASNRSIGRGTMILLNDRIGSAFYTTKTNGNMLDTFKSYEAGFLGMILDQRPHFFYSPATPTGKVHFDVSNTTELPAVEILYGYQGLNPNLAKAAVDLGAKGLVLAGMGAASWTDPGNEVIDGLISNQSIPVVYSHRTMDGFSDYYYNGIPSYFQNPQKARYMLMLSINAGYSIQNITDIFSLEY

SEQ ID NO: 10153 - protein, 155 aa, Zea mays
  unsure (1)..(155): unsure at all Xaa locations
GKSGKDGWLPPGHGDVVSLFGNTGQLDILLAQGKEYVFAAYSDTLECYXVDLMILNHLINNQSEYCMEVTPNTLSDNKGGTLISYKXEVTCRTLPKYPIEHVNEYKYIQXVKIFNTNIXWVNLTALNRLRNAEALNIDILANPIEPDGVKVLLLE

SEQ ID NO: 10154 - protein, 348 aa, Erwinia chrysanthemi
MERWFKSLFVLVLFFVFTASAADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVLNDRIGSARYITKTNASTLDTFKANEEGYLGVIIGNRIYYQNRIDKLHTTRSVFDVRGLTSLPKVDILYGYQDDPEYLYDAAIQHGVKGIVYAGMGAGSVSVRGIAGMRKAMEKGVVVIRSTRTGNGIVPPDEELPGLVSDSLNPAHARILLMLALTRTSDPKVIQEYFHTY

SEQ ID NO: 10155 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVLALQGEKGVVECAYVEGDGQYARFFSQPLLLGKNGVEERKSIGTLSAFEQHSLDA

SEQ ID NO: 10156 - protein, 345 aa, Methanosarcina barkeri
MIIMSKTAAVIKGDGVGPELVDAMLKVTEAAGTDVEFVMCEAGAGWWEKHGGNSLIPNETWDVLDSSDACFKGPTTTPGGIGSPRSVAVSIRSKYNLYANVRPIKTFPNSSAPLGDVEMICVREGTEGLYIGEEIQLTDDVSIAIRKITRTASHKIASYAFEEAKRRGYDAVVPIHKSNILKLTCGSFLEEVEKVGQNYPDIEIWPYHIDNIAQQLIKNPQIFNKKVLLSTNLFMDVISEECSALVGSIGLIYSANIGDSFAMFEPAHGSAPKYAGQDKVNPVATVLAGAWMLDYLDEKEKSEAIFKATKRVISEGKYVTYDLGGNAKLSQMAGEIAKYTAEILK

SEQ ID NO: 10157 - protein, 337 aa, Zea mays; identical to SEQ ID NO: 8670

SEQ ID NO: 10158 - protein, 519 aa, Zea mays
MLGVGMAAAVLLGAVALVLADAAARRAHWWYREAAEAVLVGAVALVVVDAAARRAHGWYREAALGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 10159 - protein, 428 aa, Microtetraspora sp. ATCC 39727
MIPPHTLLVFFVQAAALLLLALLLGRLAVRLGLAAVVGELCAGVILGPSVLGQVAPGAEQWLFPSPSSHMLDAVGQLGVLLLIGLTGAHLDLRLIRRQGATAVRVSAFGLVVPMALGIGAGLLLPAEFRGTGGSAVFALFLGVTMCVSSIPVIAKTLMDMNLLHRNVGQLTLTAGMIDDAFGWVLLSVVTAMATAGAGAGTVVLSIASLLGVIVFSVVIGRPAVRVALRTTEDQGVIAGQVVVLVLAAAAGTHALGLEPIFGAFVAGLLVSTAMPNPVRLAPLRTVTLGVLAPLYFATMGLRVDLTALARPEVLAVGLLVLALAIIGKFLGAFLGAWTSRLSRWEALALGAGMNARGVIQMIVATVGLRLGVITDEIFTIIIVVAVITSLLAPPLLRLAMTRIEATAEEEARLLAYGLRPGEAREDVR

SEQ ID NO: 10160 - protein, 70 aa, Gossypium barbadense
HVDILLASVILFIVVKTAVVCVVAKAFGYSVRTSFHVGVLLAQIGEFAFVLLSRASNLHLVEVPLSSLPF

SEQ ID NO: 10161 - protein, 582 aa, Bacillus subtilis subsp. subtilis str. 168
MGYYLTWLTISRKKEICLNNIKKTKEGHLETTLRGKEVLSIPTLNKGVAFSLEERQELGLEGLLPPTVLSLDQQAQRAYEQFQAQPDRLRQNVYLSDLANRNEVLFYKLLKNHLREMLPVVYTPTVGEAIQEYSHEYRRPQGIYLSIDNIDGIEKAFENLHATAGDIDLIVATDSESILGIGDWGVGGINIAIGKLAVYTAAAGIDPSRVIPVVLDVGTNNEKLLNDPLYIGNKHERVQGERYEAFIDAYVKAALKFFPKALLHWEDLGNKNARNIMKKYNHEILTFNDDIQGTGAITLAGVLAAMKKTGASIKDQRVVIFGAGSAGIGIADQIRDTMVLAGLSEEEANKRFYTLDYRGLLTEDIEGILDFQKPYLRNADEVKDWKRDEKGQIPFDEVVRQAKPTILIGTSGVSGAFTEEIVKEMASHVDRPVIMPMSNPTHLAEAVPEDLFKWTDGKVLIATGSPFDNVEYNGVSYEIGQSNNAFAFPGLGLGSIVAEARIITPAMFAATADAIAEMVDLETPGAGLLPSIDKLQEVSIQVAIAVAEAAIKDGVANRQPEDVKQAVLDAMWTPEYKKVIAK

SEQ ID NO: 10162 - protein, 368 aa, Chara vulgaris
KVGINGFGRIGRNFLRCWHGRPDSPLEVIAINDSGGVKQATHLLKYDSMLGTFNADVKTVDETHISVDGKVIQIVSNRDPLKLPWAELGIDIVIEGTGVFVDGPGAGKHIQAGAKKVIITAPAKGSEIPTYVVGVNEGDYHHDVSNIISNASCTTNCLAPFVKVLDEEFGIVKGTMTTTHSYTGDQRLLDASHRDLRRARAAALNIVPTTTGAAKAVALVLPKLKGKLNGIALRVPTPNVSVVDLVVNVENKGCTAEDVNDAFRKAANGPLKGVLAVCDEPLVSVDFRCTDVSSTVDSSLTMVMGDDMVKVVAWYDNEWGYSQRVVDLAHLVAAKWPGAKPAPDGKDADPLGTYCESNPDDAECRVFE

SEQ ID NO: 10163 - protein, 91 aa, Oryza longistaminata
RDAKARYVKFHWKPTCGVSCLMDDEATLVGGKNHSHATQDLYDSIAAGNFPEWKLFVQVIDPEEEERFDFDPLDDTKTWPEEEVPLRPVGR

SEQ ID NO: 10164 - protein, 385 aa, Triticum aestivum
  unsure (1)..(385): unsure at all Xaa locations
QPNPPIPPGFRSVLRRRGQRSPSPASGEQQQQQQWRRRSQPNRPIPSAPSSKLTTETGAEISVSTLDLERGGAAMASPQVLPFLCAVLLLGGAPXPARRHAPPQAGAAGQSTYTAPSCREHTASLLDFGGVGDGNTSNTAAFRKAVEHLSQYSGEGGGGGMLYVPAGRWLTAPFNLTSHFTLFLHADAVILGTQDVTQWPVIDPLPSYGRGRDHAGGRYASLVSGSNLTDVVITGNNGTIDGQGATWWSKYKSGKLKYTRGYLIELMHTDGVFISNVTLVNSPAWNIHPVYSRNIVVSGVTILAPTKSPNTDGINPDSCSQVRIEDCYVVSGDDCVAIKSGWDEYGIAVGMPSEHIVVRRLTCVSPTSAVIALGSEMSGGIRDVR

SEQ ID NO: 10165 - protein, 471 aa, Bacillus cereus ATCC 14579
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLNGFGIHIPTILSSAPGTGKGGIIDLPAVLIILVMTVLLSRGVRESARVNNIMVFIKIAVVLIFIFAGFNYVKPENWTPFMPFGLNGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGIWMVIGIAVYFLYSRKHSALNNSKKEEDVANL

SEQ ID NO: 10166 - protein, 496 aa, Haloferax volcanii
MVDDIATDADWNALYIDGEWTESESGESIAVEDPSTRETVAHVPRGTEADVDAAYEAAAEAQESWAEAPPARRQEVVEQFLQALNEYEDEIIDLLAHEVGGSRIMGETSIQIASDHASEAATLPRRMRGEHVASNIPGKENIVQKNPKGVVTVISPWNFPLNLSMRAVAPAVAAGNAVVLKPSTNSPITGGLLFAKLFEETDLPEGVVNVVTGRGSEIGDRVAGHPESDVVAFTGSTEVGKRVSGIAGENLAVPAMELGGNNAHVVTEGADVDRAADAAVFGSFVHQGQVCISINRHIVHESVYDEYVEKLTERAAELPVGSAHEDDTVVGPIIDESQRDEMLGYVEETVAAGATLETGGSTADLDGVDDSLVVQPTVLSGVTNDMAAARNEHFGPIAPVIPFSDVDEAVELANATEYGLSGSVHAGDLATGKEIALRMETGNVHVNDQPINDEAHVPFSGTGASGVGTYNSDAFLDEITEDKWISLQHEPRDYPL

SEQ ID NO: 10167 - protein, 394 aa, Zea mays subsp. mays
LGSARRARLPPGEMGWPLVGGMWAFLRAFKSGKPDAFIASFVRRFGRTGVYRSFMFSSPTVLVTTGEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 10168 - protein, 567 aa, Solanum ptychanthum
PRKGCDVLVEALEREGVTDVFAYPGGASMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 10169 - protein, 158 aa, Pseudomonas putida KT2440
MSVSSSSFTDGGVIALQQVGQDPACGAGEERTPQLSWDNLPAGTRSLALIMFDPDGGKGVGVVHWVAYNIDPEHDGLKEGMAGVSGPYVTVGRNSRGTQSYRGPCPPAGDNPHHYALTLIATDLPLGTLPEGLDRSGLLQLLQGHALGAQSLVGRYGH

SEQ ID NO: 10170 - protein, 814 aa, Cymodocea nodosa
MDREVGPHGGGRDHGSNYKQLLLLAYQSLGVVYGDLSTSPLYVYRSVFSGKLQHHQDDDAIFGVFSLTFWTLTLVALLKYVVIMLSADDNGEGGTFALYSLLCRHAKFSLLPNQQAADEELSTYYRPGYAPRNAASFKRFLEKHKRLRNLLLVIVLFGAGMVIGDGTLTPAISVLSSISGLQVRAKNLTDDEVVIIACMVLVGLFALQHYGTQKVAFLFAPVVMLWLLCIGVIGLYNTIHWNRRIYHALSPHYIYRFFKATGKDGWLSLGGILLSITGAEAMFADLGHFNKASIRIAFVGVIYPCLVLQYMGQAAFLSKNLIDFPTSFYASIPESVFWPVFVVATLAAIVASQAVISATFSIVKQCHALGCFPRVKIVHTSRWIYGRIYIPEINWILMVLCLAVTIGFRDTRLIGNAYGIAYITVMFVTTWLMALVIFFVWQKNIGFSLLFLLFFGVIDVIYLSSSLMKVPQGGWVPIILSLIFTIIMYVWHYGTRRKYQFDLQNKVSMKWILSLGPSLGIVRIPGIGLIYTELVTGVPAIFSHFVTNLPAFHEVLVFVCVKSVPVPFVPLEERYLVGRIGPRSYQMYRCIIRYGYKDVKKDDDDFENQLVMSIAEFIQMEAEEATSGGSGEASAFDGRMAVIRTSGSFGSRPRLVTRNADETESIVSIRSSKSETLQSLQSLYEQESPSWARRRRVRFELPEATQVLDDQVREELSSLVEAKHAGVTYVLGHSYIKARKTSSFLKKFVIDVAYSFLRKNCRGPAVSLNIPHVSLIESLKQRDSCSRFSKRNNRRMLKLVKFPVFTKRSQKKDQ

SEQ ID NO: 10171 - protein, 198 aa, Actinobacillus pleuropneumoniae serovar 1 str. 4074
MQQTMKKATNLLIIDNHDSFTFNLVDLLRKIGVPMKVVLVEQLVLDEVENFSHILISPGPDVPRAYLQTFEMLKRFHQTKSILGVCLGHQTLCEFFGGELYNLNEVRHGQQRPLIQISDNPLFDGLPERFNIGLYHSWAISQKSLQNTPLIATAVCDQDVLMAFKHQHLPIYGVQFHPESFITEYGEQILRNWLQIDY

SEQ ID NO: 10172 - protein, 184 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 10173 - protein, 342 aa, Methanosarcina acetivorans C2A
MTKTAAVIKGDGVGPELVEAMLKVANAAGTDVEFVMCEAGAGWWEEHGGNSLVPDETWQILDSSDACFKGPTTTPGGIGSPRSVAVSIRRKYDLYANVRPIKTFPNSNAPLGDVEMVCVREGTEGLYIGEEIQLTDDVSIAIRKITRTASGKIARYAFEEAKRRGYDTVVPIHKSNILKLTCGSFLEEVEKVAQDYPNIEVWPYHIDNIAQQLIKNPQIFNKKVLLSTNLFMDVISEECSALVGSIGLIYSANLGDNFAMFEPAHGSAPKYAGLDKVNPVATVLAGAWMLDYLGEKEKSEAIFKATERVISEGKYVTYDVGGNAKLSQMADEIAKYTAEILK

SEQ ID NO: 10174 - protein, 488 aa, Scytosiphon gracilis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRNAASTCGPLKAALDLWKDITFDYTSTDTPDFVEVATGSR

SEQ ID NO: 10175 - protein, 357 aa, Xylella fastidiosa Temecula1
MSKKILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRYPKQFDVIVTENMFGDILSDQASMLTGSIGMLPSASLDANNKGMYEPCHGSAPDIAGQGVANPLATILSVAMLLRYGMGYIKTADAIEYAVGVVLDSGLRTADIWSEGMTKVGTVAMGDAVVAAL

SEQ ID NO: 10176 - protein, 279 aa, Pseudomonas fluorescens PfO-1
MIKKCLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTEMKGLGHAILTGRPLIGDEPFAVVLADDLCVNLEGDGVLTQMVKLYKQFRCSIIAIQEVDPQETSKYGVIAGEMIRDDIYRVHSMVEKPKPEDAPSNLAIIGRYILTPDIFDLIEQTEPGKGGEIQITDALMKQAQNGCVMAYKFKGKRFDCGGAEGYIEATNFCFENFYKTGKAY

SEQ ID NO: 10177 - protein, 378 aa, Cucurbita maxima
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 10178 - protein, 909 aa, Eremothecium gossypii
MSGVSLGRRANSTADVITVNPEVLGSAKQFVGTPVLINGVQFAAFVLAFMLLRLRLKRIYQPKSSFRLINDEKKPDPLPSGPWQWFVPLLKSSHNLIIQQAGVDGYFFIRYLYVFAAYSFVSTLWIPPLLLPLNVQGEDQKDSLDRLSLSNLGENQGKYLYAHVLVSLVYFWGLLFVIYRELTYYTAIRHVVLSSPRYAKKLSSRTVLFQSVPEQYLSETEFSKLFVGVKRIWITRAASDLGSKVAERDNVAMQLEAAATSYLRTGVLRASKLKKKTGQTITDQIADYVPAKRRPRHRLRILGKKVDTIDYTKEKLIELNEEIFKMQANHMDARPFNSVFVEFESQFYAQEAQRSLPHHMPYCLRPAYVGIRPADIIWFNMRKFWFERIAAKLIAGVSITGVIVLWAIPVGAIGIFPQKIRSAKSDPTNKWGRLVPPEPMDGILISLLPTILLYVLMMLLPIFIRRMAIFAGAPSVQHVEYYTQRAFFAFQLIQIFLIRTVSSVAYVLIKELINNPTAIMNELALKVPQASNFYLGYIVTILLSLSSSLLLQLAPLVLFYVMGLLFDSTVRKQYMRFITLPTPEWGTTFAVYTNLAVIVMAFSITSPLILPLAAVGFFAAYVGYLYSLIYVYKESPDARGIHYPRALFQTLTGVYISQIFLFLMVILRKAWGPIVIQAICLAGTILAHYNMAQAFNELIDSVPVDTMKPLDGKSETPSFKPPPRADDEDLVQELPPFPVRQYQTRTVSGDQKASSMLSEFTYEYYNKNGAPNSTVATVPLLSDGDIVPIPKAPFWKRYFLPHIYYSYRAVKTRLPEIYNLPDPDEKETDEENALAYCYPAVSAKCPCLWLPRDPYGFSKNLIAYLEDAVSASDEGAEISENGKIEVYRDVQPPETSSKPKAEKPNTEYL

SEQ ID NO: 10179 - protein, 773 aa, Zea mays
  unsure (1)..(773): unsure at all Xaa locations
MPRKASSNSDARAKSRKRKRAAASASPSKQPDDHSDDSDTAAAANGDDETSRAASVNGGGGTLAGVAGDDDPVLDLRAAEVLSSSAEPVSAFPAAVRRAVSRPHPSVLAVIAAERAAASSDDAPVTPASVPVLENISHGQLQVISAMLPDHPSLAYDPVKPSTYVCTPPPLMEGCGVHKQFYDKLHIVPRHSGWFVPQTVHRLERQVVPQYFSGKSQGQTPEKYIMLRNKVIAKYLERPGKRLVFAECQGLVTSTPELYDLSTIVRFLESWGIINYXATRSVYRGPWAASSLVPHETTGELQLVSAPMKSIDGLILFDRPKCSIQANDISSLVSTSSAPFVVNHDGDSANLDEKIWERLSESSCSFCSQPSHASDYESQKETDIALCSDCFHNAKFVTGHSNLDFQRVDAMKDGSDTDGDRWTDQETLLLLEGIEKFNDNWNHIAGHVGTKSKAQCIHHFIRLPVADGLLENIEVPEASLPSGMQSSGFLHSDSNGSTSGSQPGNQIPFINSANPVMSLVAFLAAEVGPRVAASCASAALSVLTREDSRMNAEGIDAMGHGTHLNYGPSSSISSETVKNAASCGLSAAATKSKLFADQEEREIQRLSATIINHQLKRLELKLKQFAEVETMLLKESERLDLMRQQLVTQRIRMLSTRFTSTGGTIPGGSSGMVSNLMNQASGLRPPLMMPGSVTQSSMPAMYANNMQGHPQMALLQQRQQMLSFGPRLPLSAINPGSSSSAPNMMFNHGMPNSAAPNHHPLLRSPSGDNSNVG

SEQ ID NO: 10180 - protein, 494 aa, Sorghum bicolor
MAAADVPRPSFIGGDWREPCLPVCQPSTEATIGDIPAGTAEDVEMPVARGRVSDGGALVACLWGRASQLSHTIAAKIKDRKSESLALLETLDSGKPLDEASADMDDVAACFEYYADLAEALDGKQRSPISLPMENFKSYVLKEPLGVVGLITPWNYPLLMATWKVAPALAAGCTAVLKPSELASVSCLELGAICMEIGLPPGVFNVITGLGLKLVLHYPHIPCGIRLLLLGSTETGKRIMTSAAQMVKPVSLELGGKSPLIVFDDIRDIDKAVEWTMFGILPNAGQVCSAASRLLLHEKMAKKFLDRLVHGAKNIKVSDPLEEGGRLGSVVSEGQYEKIKKFISTARSEGATILYGGARPQHLKRGFFLEPTIITDVSTSMQIWREEVFGPVICVKEFRRESEAVELANDTQYGLAGAVISSDQERCRAISKALQSAIDNCSQPCFVQAPWGGNKRMFGRELGEWGLDNYMTVKQVTKYCSDEPWGWYQPPSKL

SEQ ID NO: 10181 - protein, 90 aa, Triticum aestivum
QHPIVPGDLLTAGAHHDLVASFTAGILHSDDEALRRGSVFLGLEVHLDEAGDLVGRVHRGLLPTQHVAETLSDLDAGGVARRRSDDEIHV

SEQ ID NO: 10182 - protein, 314 aa, Fragaria x ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 10183 - protein, 251 aa, Fucus vesiculosus
MASRDDLVYMAKLAEQAERFDEMVDHMKAVAQQPKELSVEERNLLSVAYKNVIGSRRASWRVISSIEGKDTVSDQLPLIRDYKSKIETELTDICADILKIIEAELIPNSTSEEGKVFYYKMKGDYHRYLAEFQSADERKTSASDALDAYQLASDHANQDLPPTHPIRLGLALNFSVFYYEILNSPDRACGLAKAAFDDAIAELDTLSEESYKDSTLIIMQLLRDNLTLWTSDQGEAEEAPGNADGTVVEDL

SEQ ID NO: 10184 - protein, 322 aa, Halobacterium sp. NRC-1
MVRARHFDERALALQRRGWMPGYPPFKGQEGSQVGAAHALAGDDWLFPTYRSNAMQLARGVPASDLLLFRRGRAEFHSDHDHNVFPQAVPIASQIPHAVGAGMAMSYTDSGQASLAYFGDGATSEGDFHQGMNFAGVFDAPVVFFCENNNWAISLPRERQTASDSIAAKADAYGFEGVQVDGNDPLAVYETVTDALAGARDGTPILVESLTYRQGAHTTSDDPDRYRPEEEDLPAWRTADPVDRYADYLHDQGVIDAGFVEECFDAAADEIDDAVETAEAAGAPAVDELFDHVYAERTPRIDDQKAWLESWLETHDPQEMEF

SEQ ID NO: 10185 - protein, 316 aa, Musa acuminata
MDSFPVIDMEKLSGGERGAAMEILRDACEKWGFFEILNHGISHDLMDEVEKVNKEQYNKCREQKFNEFANKALENADSEIDHLDWESTFFLRHLPVSNISEIPDLDDQNAMKEFAAEIEKVAERLLDLLGENLGLEKGYLKKAFSNECKGPTFGTKVSSYPPCPRPDLVKGLRAHTDAGGIILLFQDDQVSGLQFLKDGEWLDVPPIRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 10186 - protein, 162 aa, Triticum aestivum
  unsure (1)..(162): unsure at all Xaa locations
STNTHLCKRASYQKKSPRKRPRGPAGRGQEWQQTAALRKRRPATMAAIHGADGRGASAIADKGHCVVYPPGGERFEVPLAYLSTTVFGELLRMSEDEFGFXSEDRITVPCNAAVMAYVICLLKRKPSEEVERAVLSSVVMPRSNQSGIAMVCTGLGQSMAIF

SEQ ID NO: 10187 - protein, 476 aa, Erythrophyllum delesserioides
NERYESGVIPYAKMGYWDPDYVVKDTDILALFRVSPQPGVDPVEASAAVAGESSTATWTVVWTDLLTACDLYRAKAYKVDAVPNTTDQYFAYIAYDIDLFEEGSISNLTASIIGNVFGFKAVKALRLEDMRLPVAYLETFQGPATGVIVERERMDKSGRPFLGATVKPKLGLSGRNYGRVVYEGLKGGLDFLKDDENINSQPFMRWKERFLYSMEGVNRAIAASGEVKGHYMNVTAATMEEIYERAEFAKQLGSIIIMVDLVIGYTAIQTMAIWSRKNDMILHLHRAGNSTYSRQKIHGMNFRVICKWMRMAGVDHIHAGTVVGKLEGDPLMIQGFYNTLLQPYLAVDLPKGIFFEQDWASLRKVTPVASGGIHCGQMHQLLDYLGVDVVLQFGGGTIGHPDGIQAGATANRVALESMVIARNEGRDYVTEGPQILQDAAKTCGPLQTALDLWKDITFNYTSTDTADFVETPTANV

SEQ ID NO: 10188 - protein, 499 aa, Escherichia coli K12
MSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 10189 - protein, 500 aa, Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 10190 - protein, 145 aa, Synechococcus sp. PCC 7942
MSDWLEHSVQVEVAVPVARAWELWSDLEQMPRWMKWIDSVQVQKDDPELSRWKLASQGFEFSWLSRITRLVPQQLIQWESVDGLPNRGAIRFYDRQDHSIVRLSISYAIPGGLGPLMDKLFLGRIVEGTLKADLDRFRHYAESPR

SEQ ID NO: 10191 - protein, 394 aa, Glycine max
DLDGDSWTDQETLLLLEAVEVYNENWNEIAEHVGTKSKAQCILHFLRLPVEDGKLENINVSSLSLLSNVKNQEDIGRLHCFSNGDSSGPVHNSQDSDGRLPFTNSGNPVMALVAFLASAVGPRVAATCAHAALASLSGNNSGSTAHIEAVENDNRTNSESIHNRDGGHDGEVANSNQKNKDMSKVLGSCGQHEGGSILLSAEKVKDAAKAGLSAAAMKAKLFADHEEREIQRLCANIVNNKLKRLELKLKQFAEIETQLMRECEQVEKVRQRLASERSHIISTRLGNGGTTPMNIAGVGPSTINNNSNGRQQMISASSSQPSISGYGNSQRVHPHMSFVPRPSVFGLGQRLPLSMIQQPQSTSSNPMVNGPSNLQPSPNHSMSRPVSRTNSDLG

SEQ ID NO: 10192 - protein, 216 aa, Enterococcus faecium
MKIAPSILSADFANLQRDIELVEKGGADYIHVDVMDGQFVPNITLGPNIVQAIRPVTKLPLDVHLMIVDPENYIPAFAKAGADIITVHVEATPHIHRALQMTKSLGVKAGVVINPGTPVSMIKHVLPLADQVLVMTVNPGFGGQSFIEETVEKITELADLRRENNWTYAIEVDGGIVPETAKICKDAGADVFVAGSYIYGAENPVGQIERLKEALD

SEQ ID NO: 10193 - protein, 464 aa, Salmonella typhimurium LT2
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLILSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 10194 - protein, 305 aa, Thermus aquaticus
MLVTGLEILKKAREEGYGVGAFNVNNMEFLQAVLEAAEEQRSPVILALSEGAMKYGGRALTLMAVELAKEARVPVAVHLDHGSSYESVLRALRAGFTSVMIDKSHEDFETNVRETRRVVEAAHAVGVTVEAELGRLAGIEEHVAVDEKDALLTNPEEARIFMERTGADYLAVAIGTSHGAYKGKGRPFIDHARLERIARLVPAPLVLHGASAVPPELVERFRASGGEIGEAAGIHPEDIKKAISLGIAKINTDTDLRLAFTALIREALNKNPKEFDPRKYLGPAREAVKEVVKSRMELFGSVGRA

SEQ ID NO: 10195 - protein, 535 aa, Schizosaccharomyces pombe
MLTSWRTISLLQKTTSRFIKRSKTYADVRYNSQALQNHGVPGNKRKWMKRFVFVGAAGIGVYAWDRVYNAHALTRSIRTVYTASIIAADYKLNFSEKKADKIDALHQRVAQRLFKTIYKNGGLYIKMGQIIAMQSNNLPEAYGKAFQGMFDNAPQVEWEELQDIFKEQYGRPVEEVFASIEKRAAASASIAQVHRAVLPSGEKVAVKIQKPDVAKQMSWDLLVYKYMMYVYDKWIFHIPLYFTVDYVSERLRSEVDFTTEANNSEHAREGVEETDYLRDKIYIPKVYKEISGKRVMVTEWADGIPLYDQTALSEAGMSKKEILTNLFRFLAFQMFHSKQVHCDPHPGNILVRKNQAGLCQTVILDHGLYVFESEKFRKEFALLFTAAYSLDKKSILQVMDAWGIGQPELFANRMLNIPMDEEQPHTGEKIISKKEAFQQQLAERKKFIGFLQDCTRLPKELLMLGRCLMLIQKNNQNFGYPVNSIAVMAKVADKYTTDKPSPTWYQRLLSPIFWVFQHLFYPGNFRLPELTNDKK

SEQ ID NO: 10196 - protein, 245 aa, Nicotiana tabacum
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKARFEVLQRNQRHYAGEDLDSLSMKELQNLEHQVDSALKHIRSRKNQLMHESISELQKKDKALQEQNNKLSKQVKEREKELAQQTQWEQQSHDHLNSSTFVLSQPLSSLHLGEAYSTAGDNGEVEGSSRQQQQNTVMPPWMLRHLNN

SEQ ID NO: 10197 - protein, 293 aa, Micromonospora griseorubida
MRGVLLAGGTGSRLWPITQAVSKQLMPVFDKPMIYYPLSTLIMAGVREIMVVTTPEDQPQFTRLLGDGQQWGLSLSYGVQPRPEGIAQAFVIARDFLDGGPAALILGDNIFHGVGLGRKLRGHTNPEGGEIFGYPVADPSAYGVVEFDESGRVLSIEEKPTRPKSRYVVPGLYFYDADVVEIASQLKPSDRGELEITAVNNEYLRRGQLTLTLLDRGTAWLDTGTFGDLVQAGEYVRVIEERQGFKIGCVEEAAWRAGFLSDDELRELAVPLLRTAYGEYLLRLLDWKGESSA

SEQ ID NO: 10198 - protein, 543 aa, Aspergillus oryzae
MSLSTSSGDFVRLAFVQYTVFLVSINAPAWDYNLVALDYLPKCDLHWVGNCNELNAGYAADGYARINGMSALVTTFGVGELSALNAIAGAYSEFVPIVHIVGQPHTKSQKDGMLLHHTLGNGDFNVFTRMSADISCTLGCLNSTHEVATLIDNAIRECWIRSRPVYISLPTDMVTKKIEGERLDTPLDLSLPPNDPEKEDYVVDVVLKYLHAAKKPVILVDACAIRHRVLDEVHEFVEKSGLPTFVAPMGKGAVDETHKNYGGVYAGTGSNPGVREQVESSDLILSIGAIKSDFNTTGFSYRIGQLNTIDFHSTYVRVRYSEYPDINMKGVLQKIVQRMGNLNVGPVSPPSNLLPDNEKASTEQAITHAWLWPTVGQWLKEKDVVITETGTANFGIWDTRFPAGVTAISQVLWGSIGYSVGACQGAALAAKEQGRRTVLFVGDGSFQLTLQEVSTMIRNNLNPIIFVICNEGYTIERYIHGWEAVYNDIQPWDFLNIPVAFGAKDKYKGYKVTTRDELRELFANEEFASAPCLQFEIDSRIGR

SEQ ID NO: 10199 - protein, 587 aa, Hordeum vulgare subsp. vulgare
VSGPLMCVFLDGWLAAAVTALRCMVDAMHAWNLLTQLRVARAAAAAVARGRRGVADEEQAEADAAAARSLPAYARSRRGMALDFFVILPVMQVVVWVAAPAMIRAGSTTAVMTVLLVAFLLEYLPKIYHSVSFLRRTQDQSGHIFGTIWWGIVLNLMAYFVAAHAVGACWYLLGVQRATKCLKEQCLLTGPPGCASGPVACAAPLYYGGAGAAASVVGDRLAWATDDKARSVCLVSGDKYQFGAYKWTVMLVANTSRLEKMLLPIFWGLMTLSTFGNLESTTEWLEIVFNIITITGGLVLVTMLIGNIKVFLNATTSKKQAMHTRLRSLEWWMKRKDLPQSYRHRVRQFERQRWAATRGVDECQIVRDLPEALRRDIKYHLCLDLVRQVPLFHHMDDLVLENMCDRVRSLIYPKGETIVREGDPVQRMVFIVRGHLQCSQELRNGGTSCCMLGPGNFTGDELLPWCLRRPFAERLPASSSTLVTLESTEVFGLEAADVKYVTQHFRYTFTNERVRRSARYYSPGWRTWAAVAVQLAWRRYKHRKTLSSLSFIRPRRPLSRCSSLGEEKLRLYTAILASPKPNQDDGF

SEQ ID NO: 10200 - protein, 314 aa, Mesorhizobium tianshanense
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 10201 - protein, 124 aa, Zea mays
  unsure (1)..(124): unsure at all Xaa locations
SLRLRIEARGFIFGPAIALAIGAKFIPLRKPKKLPGEVFSESYVLEYGMDCLEMHVGAIEPGEXRVVVVDDLVATGGTLSAAIRLLERAGANVVECACLIGLPKFKDFYKLNGKPVYILVESRK

SEQ ID NO: 10202 - protein, 176 aa, Glycine max
ELEDMKKRLKEIEEEASALREMQAKVEKEMGAVQDSSGTSATQAEKEEVDARSIYVGNVDYACTPEEVQQHFQSCGTVNRVTILTDKFGQPKGFAYVEFVEIDAVQNALLLNESELHGRQLKVSAKRTNVPGMKQYFGRRPAGFRSRRPFMSAPFFPPYGYGRVPRYRRPTRYRPY

SEQ ID NO: 10203 - protein, 317 aa, Oryza sativa
EKYNHRESTVRFINSTFLFLLPFLLLAFVYSLFFPGYFSILPSLAARCSNSVAATPANATGPAVDLRVLLGVVTRAEMYERRALLRLAYALQPAPARAVVDVRFFVCSLAREEDAVLVSLEIIAHGDVVVLNCTENMDDGKTHSYFSSLPALFADAPYDYDPYDYVMKADDDIFLRLPRLLASLGAMPREDAYYGATIPCGSMDPFREYMSGMAYALSWDVVEWVATSDVPRNRTVGPEDRMTGQWLRLGGRGKNRFNAKPAMYDYPLPAPVDKCSHEFIPDTIAVHRLKDNPRWAETLKYFNFTKGLEPSKFYKIN

SEQ ID NO: 10204 - protein, 85 aa, Oryza barthii
KARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 10205 - protein, 304 aa, Haemophilus somnus 129PT
MMTHHSLKHISDRIKQALNQIENRNLAQDLWYILGEQNFQGFLPAFTVNHFCEKYHMTDKELALILLPVSACYANPTISHFSVGAIAKGESGSFYFGANQEFCTTNIQQTVHAEQSAISHAWMRRESKITEITVNYTPCGHCRQFMNELNSAETLRIHLPHSQDNLLHHYLPDAFGPHNLQIDNRLFDKKAHNLFFVTEDPLIQAALDAANQSHAPYSKTYSGIALQLQDQQIFQGSYAENAAFNPSLPPLQTALNYLLLNGNEVENIARAVLVEQPFRLSYRGMTEELLAYLGDIPLDYIQVS

SEQ ID NO: 10206 - protein, 63 aa, Glycine max
LISDCNGACAARCRLSSRPRLCQRACGTCCRRCNCVPPGTAGNQEVCPCYASLTTHGGKRKCP

SEQ ID NO: 10207 - protein, 369 aa, Streptomyces avermitilis MA-4680
MTKNGSTRAPLIALTALAPVSWGSTYAVTTEFLPADRPLFTGLMRALPAGLLLLALARVLPRGAWWWKSAVLGALNIGAFFPLLFLSAYRLPGGMAAVVGSVGPLFVAGLAAALLSERPTVRTLLTGIAAALGVSLVVLKAAGALDPLGVLAALAATASMSTGTVLTKRWGRPAGVGPLALTAWQLTAGGLLIAPIALLVEGTPPALDGRAIGGYLYLALANTAVAYWLWFRGIGRLTATQVTFLGPLSPLTAAVIGWAALGQALTPVQLAGMAVAFGATVFGQLRPRAQDRRRHRETTAVPLDAGPNSNAATTAPGAAAVPGAPTATAAPSVPTATAAPTVPGATAAPSAPTAPTATTATTATTPNGS

SEQ ID NO: 10208 - protein, 129 aa, Oryza sativa
MAKHQADLVRCSRQPGAAVGRVCAAHDGRCVACDSMVRPAAPARVCDGCSGGGGGHGSRSERCLVCGAGAGEGGAAAVADAYYCRSCVQMEKDRDGCPAVVNAGTARRDAAAFFFSARSKRGGFRSTMA

SEQ ID NO: 10209 - protein, 495 aa, GIBBERELLA ZEAE PH-1
MSTVKITGIGGRQISVHTGLFINNEFVPAQDNATVKTENPFNGKVLADISAAQASDVDKAVAAAEKAFNGTWKLTQPTVRRDLMNRLADLIERDNEELASLESVDAGILFRESSGMFVPQAVETLRYYAGWADKVDGQSLHIPQGISYSRRVPIGVCAAIVPWNAPLMITMWKLAAALATGNVLIIKTPEASPLYGQKLGQLIVEAGFPPGVVSILCGLGIVAGSALSAHPAIRKLSFTGSPGVGRQILAASAKTNLKKISLELGGKGPSIVFDDADFENALQWTAAGITVNNGQICAAGSRIYVHADIYDKFVKAFSERTKDSVAGDPLLQETTKGPVINAGQKKRVMEYIKIGQDEKVKVLHGADDSKLPTEGHFVPNTAFVDVDPQATVIREEIFGPVACIAKFSTEEEVVRLANDSSYGLGSAVFTKDINKAIRVSEELESGQVTINMWGVVNANVSFGGFKESGFGRDCGKEAIDDWTQAKYISVMVPKL

SEQ ID NO: 10210 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 10211 - protein, 352 aa, Zea mays
MHSSIPQTIKYPQIARWLARMEKQLPALTGGSKAATTTPFYLALDHRAAATSSSPPAEAPTLPPSAAAVSDPSRQSNSDRGSEIIKAKIMSHPLYPALLRAFIDCRKVGAPLEIVGRLSALADDVETNSDGRQEEQPADPELDQFMEIYCHMLVRYRQELTRPIQEADEFFKSMEAQIDSFSLDDNGYEEGGGSSDEDEQETVDLGGLPVPETGSPSGEGKELKNHLLNKYSGYLSSLWRELSRKKKKGKLPRDARQKLLHWWQLHYRWPYPSELEKAALAESTGLDAKQINNWFINQRKRHWKPAPPTMALGTPDYRMGQHGGGASSSSASAGLRVQGQYFTGGSSYPRGP

SEQ ID NO: 10212 - protein, 220 aa, Triticum aestivum
FPTLAAIVASLATISATYSIIKQALALGCFPRVSVVHTSKKFLGQIYIPDINWVLMILCIAVTAGFKNQIQIGNAYGTAVVIVMLVTTFLMVPIMLLVWKSHWILVVTFLVLSLMVEFPYFIACINKVDEGGWVPLAVAITFFIIMYVWHFCTVKRYEFEMHSKVSMAWILGLGPSLGLVRVPGIGFVYTELASGVPHIFSHFITNLPAIHFVVDFECEK

SEQ ID NO: 10213 - protein, 340 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDAKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 10214 - protein, 283 aa, Zea mays
MAGLSLLHPMAFAFGLLGNIISFMTYLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSFSLTASAVVWFLYGLLIKDKYVALPNVLGFTFGVVQMGMYALYRNATPRVPAAKEAAAAADDGNTFNFKAPGEHVVTIAKLTAAAPATAAELIIKARDDAQHPPEEEAAAAK

SEQ ID NO: 10215 - protein, 516 aa, Gentiana triflora
MSPIYTTLTLHLATALFLFFHVQKLVHYLHGKATGHRCRRLPPGPTGWPILGALPLLGNMPHVTFANMAKKYGSVMYLKVGSHGLAIASTPDAAKAFLKTLDLNFSNRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHKRTSQERKQKPDFLDFVIANGDNSDGERLNTDNIKALLLNLFTAGTDTSSSIIEWALAELLKNRTLLTRAQDEMDRVIGRDRRLLESDIPNLPYLQAICKETFRKHPSTPLNLPRNCIRGHVDVNGYYIPKGTRLNVNIWAIGRDPSVWGDNPNEFDPERFLYGRNAKIDPRGNHFELIPFGAGRRICAGTRMGILLVEYILGTLVHSFDWKLGFSEDELNMDETFGLALQKAVPLAAMVIPRLPLHVYAP

SEQ ID NO: 10216 - protein, 214 aa, Bacillus anthracis str. Ames
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSVIEHVLEDIDMVLLMTVNPGFGGQKFIHSVLPKIKQVAEMVKERNLEVEIEVDGGVNAETARLCVEAGANVLVAGSAVYNQKDRGEAIRVIRG

SEQ ID NO: 10217 - protein, 165 aa, Hordeum vulgare subsp. vulgare
VMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCE

SEQ ID NO: 10218 - protein, 239 aa, ASPERGILLUS NIDULANS FGSC A4
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRCRQEGF

SEQ ID NO: 10219 - protein, 149 aa, Zea mays
MMSAKRLVQMSSSRWRRMAALARKRLASTPVKETDGSSCSTSSVAGKGHCAMYSADGRRFEVPLVFLGTALFGELLSMSQEEFGFAGDDGRITLPCESLVMEYMMCLLTRDASEEVKRLFLSSMARPCHYGSGLVQTMHHTQRTVVPSF

SEQ ID NO: 10220 - protein, 764 aa, Bacteroides fragilis
MKHFVRRMQAFAASLVVVAAGLQAQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 10221 - protein, 457 aa, Escherichia coli O157:H7 EDL933
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 10222 - protein, 474 aa, Bacillus cereus ATCC 14579
MKKHLYINGSWKSVNTYKPLYAPYSEETLAEIAQGTEEDVKEAVTAAKNAMTKMNKLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPNGALNIISGPGPTVGEAIVKNDYVASITFTGSPKVGIGIKQKAGLKRVTLELGSNAAVIIDEDVELTDEIIERVKWGAFVNNGQVCISVQRVFVHETKIHEFLSKLKKAMESVVVGDPSLEETDVSALISKKDVERIDMWVQEAIKEGATVLCGGKKQDARIFEPTVLTNVPDHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 10223 - protein, 129 aa, Triticum aestivum
  unsure (1)..(129): unsure at all Xaa locations
MAPTVMASSATSVAPFQGLKSTAGLPVSRRSNGASLGSVSNGGRIRCMQCXPSEGIKNSETLSYLPPLKHGGLLKQVDYLDSVQSGCLSFDFNKSVYPSRLTQCVSPGTNNGRYWTMLXXPIFGCTDAS

SEQ ID NO: 10224 - protein, 486 aa, Pseudomonas aeruginosa UCBPP-PA14
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 10225 - protein, 196 aa, Zea mays
MDLSAVQAALSDKSYTAVASLCDELLLQAASKGTNTDEWPYSVHLLAHLYINDLNSARFFWKSLPQEVKDTRPELAAVWRIGQCLWNRDYAGVNTAAQGFEWGPDLTEFITAFLESYRQRIFKLLTSAYSTISVADVAHFMGMSEEDATNYAVQIGWSLGAATKMLTVKKPKAQINQKLDASKLQRLTECVFHLEH

SEQ ID NO: 10226 - protein, 92 aa, Triticum aestivum
  unsure (1)..(92): unsure at all Xaa locations
MSSSLPMRLLVPLTLPLIPPPSSDSLAPSPLRSKNPNFILRSSSSSTSCSSSLWQLFPRRSRSSSPCVPXCTKDQDITDTWRNEDDPITCGP

SEQ ID NO: 10227 - protein, 364 aa, Ralstonia eutropha
MPEVQRMTLTQFLIEERRRYPDASGGFNGLILNVAMACKEIARAVAFGALGGLHGKASTQAGEEGAVNVQGEIQQKLDVLSNTTFLRVNEWGGYLAGMASEEMEAPYQIPENYPRGKYLLVFDPLDGSSNIDVNVSVGSIFSVLRAPEGADTVTEQDFLQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 10228 - protein, 161 aa, Lactobacillus salivarius subsp. salivarius
LLNQSKDTIIYLCVLKKQHLFQSDKPESIETTLKNAADGRDIRLIVVTDAEGILGIGDWGVDGVDIAIGKLMVYTAAAGINPAQVLPVSIDAGTNNKELLNDPLYLGNKHKRVYGEKYNELIDKFVAAVQKLFPESMLHFEDFGRSNADVILNKYKDKILT

SEQ ID NO: 10229 - protein, 299 aa, Triticum aestivum
MGAVQLESVAAQHAQAKLNVESLPQGPSLFDGNDTARINGSESDEYEKFDKGLMQYGCAHYRRRCRIRAPCCNEIFDCRHCHNESKNSIKIDTPTRHELPRHELQQVICTLCGTEQEVRQVCINCGVCMGKYFCEVCKLFDDDVSKQQYHCHACGICRIGGRENFFHCSKCGCCYSKVLKNSHACVEGAMHHDCPICFEYLFESRNDVSVLPCGHTIHEKCLREMKEHCQFACPLCSKSVCDMSKAWERLDAELATLSNSFDDKMVRILCNDCGAVSEVQFHLIAHKCHNCKSYNTRQI

SEQ ID NO: 10230 - protein, 488 aa, Sphaerotrichia divaricata
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATREVKGSYLNITAATMGQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 10231 - protein, 202 aa, Glycine max
  unsure (1)..(202): unsure at all Xaa locations
VLNASKRLPPLTVPLHDALGKVLAQDVRAPDPLPPYPASVKDGYAVVSADGPGEYPVVAESRAGDDALGLTLSPGTVAYVTTGGPIPDGADAVVQVENTEIVNHASDGTXRRVRILLPTTKGNDIRPVGXDIKKDAVVLTSGKRLGASXIGLLATVGVTMVXVYPTPTVAVLSTGNKLXEPTTGHLXSCQIXDSNRAMLXAA

SEQ ID NO: 10232 - protein, 549 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHTLGNGDFTVFHRMSANISETTAMITDICTPQAEIDRCIRTTYVTQRPVYLGLPANLVDLNVPAKLLQTPIDMSLKPNDAESEKEVIDTILVLVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDCSTKLG

SEQ ID NO: 10233 - protein, 424 aa, Batrachospermum atrum
SAAIAGESSTATWTVVWTDLLTACDLYRAKAYKVDAVPNTSDQYFAYIAYDIDLFEEASIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSIEGVNRAQAAAGEIKGHYLNVTAATMEDMYERAEFAKELGSIICMIDLVIGYTAIQSMAIWARKADMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 10234 - protein, 160 aa, Mycobacterium tuberculosis H37Rv
MSTRSARIVVVSSRAAAGVYTDDCGPIIAGWLEQHGFSSVQPQVVADGNPVGEALHDAVNAGVDVIITSGGTGISPTDTTPEHTVAVLDYVIPGLADAIRRSGLPKVPTSVLSRGVCGVAGRTLIINLPGSPGGVRDGLGVLADVLDHALEQIAGGDHPR

SEQ ID NO: 10235 - protein, 195 aa, Escherichia coli
MATLRIGLVSISDRASSGVYQDKGIPALEEWLTSALTTPFELETRLIPDEQAIIEQTLCELVDEMSCHLVLTTGGTGPARRDVTPDATLAVADREMPGFGEQMRQISLHFVPTAILSRQVGVIRKQALILNLPGQPKSIKETLEGVKDAEGNVVVHGIFASVPYCIQLLEGPYVETAPEVVAAFRPKSARRDVSE

SEQ ID NO: 10236 - protein, 307 aa, Oryza sativa (japonica cultivar-group)
MAMKKSFSLLFFLPFLLLAIIYFVIFPNEFRLQSSLAACGDSAPATAADAVAKAAPDIRVLLGVLTRADKYERRALVRLAYALQPAPARAVVHVRFVVCNLTAEEDAALVGLEIAAYGDIIVLDCTENMDNGKTYTYFSAVPRLFAGEPYDYVGKTDDDTYYRLGALADALRDKPRRDAYYGFLTPCHADPRTQYMSGMGYVVSWDVAAWVAATPELQNDLKGPEDKLFGRWLRWGGRGRNVFGAEPRMYDYLDGGMRHGPTCFRHLLQADTVAVHKLKDNLKWARTLNFFNATEGHKASPLFHVDH

SEQ ID NO: 10237 - protein, 353 aa, Glycine max
MNAESPPGLLMSVSCLSDYDLLCGEDSSGILSGESPECSFSDIDSSPPPPSPTTEDCYSIASFIEHERNFVPGFEYLSRFQSRSLDANAREESVGWILKVHAYYGFQPLTAYLAVNYMDRFLDSRRLPETNGWPLQLVSVACLSLAAKMEEPLVPSLLDLQIEGAKYIFEPRTIRRMELLVLGVLDWRLRSVTPLCFLVFFACKADSTGTFTRFLISRATEIIVSNIQEASFLAYWPSCIAAAAILTAANEIPNWSVVKPEQAESWCQGIRKEKVIGCYQLMQELVINNNQRKLPTKVLPQLRVTTRTRMRSSTVSSFSSTSSSSSSTSFSLSCKRRKLNNRLWVDDEKGNSE

SEQ ID NO: 10238 - protein, 380 aa, Zea mays
  unsure (1)..(380): unsure at all Xaa locations
MRRVALLLVAAVCALAAPAAAVVTDGLLPNGNFEDGPPKSALVNGTVVSGAHAIPRWETSGFVEYIESGHKQGDMLLVVPQGAHAVRLGNEASIRQRLAVARGAYYAITFSAARTCAQAEXALNVSVSPEWGVLPMQTIYGSNGWDSYAWAFKAKMDAVTLVIHNPGVEEDPACGPLIDGVAIRALYPPALARRAGGNNLLKNGGFEEGPYFLPGASWGVLVPPNIEDDHSPLPAWMIVSSKAVKYVDAAHFAVPQGARAVELVGGRESALVQEVRTVPGWTYRLAFAVGDSGDGCAGSMAAEAYAARATVKVPYQSRGTGGYKRAVLDFTAIANRTRVVFQSTFYHMKPDGTLCGPLVDDASLVGLRKKKPARRLMQLL

SEQ ID NO: 10239 - protein, 742 aa, Halobacterium sp. NRC-1
MNEVQLEVAKAYPNDSGRGIARLDPDTLLHLKLSPGDIIEIEGAETTAAKVWRADRQDWNTDTIRIDGFTRQNAEVGIGERVKIRKADAEKADTLVLAPPEEASVQFGSDAAGMVKRQILKRPVVARDIVPVMSSTNHPFMRSPGQAIPLIAVETEPEGVCLVTEDTDVELREEPISGFERTGGGITYEDIGGLENEIQRVREMVELPMKHPQIFQKLGIEPPQGVLLHGPPGTGKTLLAKAVANETSASFFSIAGPEIISKYYGESEQQLREIFEDAKDDSPSIIFIDELDSIAPKREDVTGEVERRVVAQLLTMMDGLEGRGQVIVIAATNRVDAVDPALRRPGRFDREIEIGVPDEIGREEILKIHTRGMPLSDDVNLSTLADDTHGFVGADIESLSKEAAMRALRRYLPEIDLDEEDIPPSLIDRMIVKREDFKGALSEVEPSAMREVLVELPKITWDDVGGLTEAKNNVKESVEWPLNQPEKFTRMGVEPPAGVLLYGPPGTGKTLMAKAVANETNANFISVRGPQLLSKWVGESEKAIRQTFRKARQVAPTVIFFDELDSLAPGRGQTGGNNVSERVVNQLLTELDGLEEMEEVMVIAATNRPDIIDPALIRSGRFDRLVQVGQPGIEGREQILKIHTQDTPLAADVSLRELAERADGYVGSDLANIAREAAIEALRDDEDADDVGMAHFRAAMENVRPTITDDLMEYYDQVEDQFKGSQGPNVNSRQGSEHIGFQ

SEQ ID NO: 10240 - protein, 267 aa, Oryza sativa (japonica cultivar-group); identical to SEQ ID NO: 7329

SEQ ID NO: 10241 - protein, 212 aa, Triticum aestivum
MEISFCRMFYFFFESRGKKEEPVVIWLTGGPGCSSELTVFYENGPFAIANNMSLVWNKFGWDKISNIIFVDQPTGTGFSYSSDDRDTRHDEAGVTNDLYDFLQVFFKKHPEFVKNDFFITGEPYAGHYIPAFASRVHQANKKNEGTHINLKGFAIGNGLTDPAIQYKAYTDYALDMNLIRKADYDRINKFIPACEIAIELCGTDVKASCMSA

SEQ ID NO: 10242 - protein, 334 aa, Oryza sativa
MKTASSSSSSSHGFPATASLCTPHLLLVPLGLLAALVVVPSLGASHVLPDGNGVLCHADAGLGVLYLVTPGGDAASTAAAAAETKAVVRPELRLLVGVLTTPKRYERRNIVRLAYALQPAVPPGVAQVDVRFVFCRVADPVDAQLVVLEAARHGDILVLNCTENMNDGKTHEYLSSVPRMFASSPYDYVMKTDDDTYLRVAALVDELRHKPRDDVYLGYGFAVGDDPMQFMHGMGYVVSWDVATWVSTNEDILRYNDTHGPEDLLVGKWLNIGRRGKNRYSLRPRMYDLNWDMDNFRPDTVLVHMLKDNRRWAAAFRYFNVTAGLQPSNLYHFP

SEQ ID NO: 10243 - protein, 359 aa, Pycnococcus provasolii
VELRDKDTAPDDYMGKDVLQAVSHVNREITTLHVGKVPTDQKAIDVAMIALDGTENKGRLGANAILTASIAVCKAGAAESGVPLWRHIGKLANNVTFVLPVPAFIIINGGSHAGNRLAFQEYMILPTGASSLTEAMKMGSEVYHKLKDIIKAKYGQDSVNVGDEGGFAPSLENNEEGLKLIVEAIEVAGYTGKVKIGMDVAASEFLVPAASEIAIYKYDLDFKAPEGAAKDEKLAAMPGDELRALYASFVQNYPVISIEDPFDQDDAENTTALTADDLCQIVGDDLLVTNPKRVQRAIDGKWCNALLLKVNQIGSVSEAIEAVGMSKNAGWGVMTSHRSGETEDSFIADLAVGLATGQI

SEQ ID NO: 10244 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 10245 - protein, 337 aa, Bradyrhizobium japonicum USDA 110
MNSLDLMMASVACIGECMVELRQAQGGHSAGQSAGQSAGQGGGLYSRGFGGDTLNTAVYLARLEVKVDYFTALGDDALSDEMIAAWNAESIGTRRVVRLPGKLPGLYMIQTDAKGERQFFHWRDSAAARQLMSLPETDELLNSLMSYDIVYLSAITLSIYDAPGRERLLAAIKRARLLGTRFVFDTNFRARGWPDRDVAREAFAAAFATADIVLTSTEDLLALYPGESRDQLMARIPSPELVFRLAEPVSLLRFPGGTSEVRAEPMTKPVVDTTAAGDSFAAAYIAARLAGSEPVEAAQAGHRLASLVICYPGAIIPGYAMPPKKRHRPAATRQATK

SEQ ID NO: 10246 - protein, 632 aa, Helicobacter pylori
MKPTNEPKKPFFQSPIILAVLGGILLIFFLRSFNSDGSFSDNFLASSTKNVSYHEIKQLISNNEVENVSIGQTLIKASHKEGNNRVIYIAKRVPDLTLVPLLDEKKINYSGFSESNFFTDMLGWLMPILVILGLWMFMANRMQKNMGGGIFGMGSAKKLINAEKPNVRFNDMAGNEEAKEEVVEIVDFLKYPERYANLGAKIPKGVLLVGPPGTGKTLLAKAVAGEAHVPFFSMGGSSFIEMFVGLGASRVRDLFETAKKQAPSIIFIDEIDAIPKSRAAGGMISGNDEREQTLNQLLAEMDGFGSENAPVIVLAATNRPEILDPALMRPGRFDRQVLVDKPDFNGRVEILKVDIKGVKLANDVNFEEVAKLTAGLAGADLANIINEAALLAGRNNQKEVKQQHLKEAVERGIAGLEKKSRRISPKEKKIVAYHESGHAVISEMTKGSARVNKVSIIPRGMAALGYTLNTPEENKYLMQKHELIAEIDVLLGGRAAEDVFLEEISTGASNDLERATDIIKGMVSYYGMSSVSGLMVLEKQRNAFLGGGYGSSREFSEKTAEEMDLFIKNLLEERYEHVKQTLSDYREAIEIMVKELFDKEVITGERVREIISEYEAANNLESRLIPLEEQAS

SEQ ID NO: 10247 - protein, 249 aa, Fragaria x ananassa
MGRGRVELKRIENKINRQVTFAKRRNGLLKKAYELSILCDAEVALIIFSNRGKLYEFCSSSSMLKTLERYQKCSYGAMEVQKPAKELEESSYREYLKLKTRCESLQQTQRNLLGEDLGPLNTKELEQLERQLESSLKHVRSTKTQHMIDLLSDLQSKEHMLIEANRDLKTKLDEIDSRTQLRQTWEHGHDHQTMLYGTQHAQTQGLMFQPLDCNPTLQIGYNAVVSQEMPAATPAHAQPVNGFIPGWML

SEQ ID NO: 10248 - protein, 420 aa, Glycine max
  unsure (1)..(420): unsure at all Xaa locations
MASLPLGHHHHHQPAAATIHPSQPPQCQPQPEVPRRSSDMETDKDMSATVIEGNDAVTGHIISTTIGGKNGEPKQTISYMAERVVGTGSFGVVFQAKCLETXEAVAIKKVLQDRRYKNRELQLMRLMDHPNVISLKHCFFSTTSKDEXLFLNLVMEYVPESMYRVIKHYTTMNQRMPLIYVKLYTYQIFRGLAYIHTALRVCHRDVKPQNLLVHPLTHQVKLCDFGSAKVLVKGESNISYICSRYYRAPELIFGATEYTPSIDIWSAGCVLAELLLGQPLFPGENQVDQLVEIIKVLGTPTREEIRCMNPNYTDFRFPQIKAHPWHKVFHKRMPPEAIDLASRLLQYSPSLRCTALEACAHPFFDELREPNARLPNGHPLPPLFNFKQELAGASPELINRLIPEHIRRQMGLSFPHSAGS

SEQ ID NO: 10249 - protein, 784 aa, Zea mays
MQSDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKSWDNIREAKEAYASSGRQQEQANRQDQLSSQFASKAQFGSTPALIKAEVPWSARRGNLSEKERVLKTVKGILNKLTPEKFDLLKGQLMEAGITTADILKDVISLIFEKAVFEPTFCPMYAQLCSDLNEKLPTFPSEEPGGKEITFKRVILNNCQEAFEGASNLRAEIAKLTGPDQGMERRDKERLVKLRTLGNIRLIGELLKQKMVPEKIVHHIVMELLGSGPDKKTCPEEEDVEAICHFFNTIGKQLDENPKSRRINDTYFIQMKELTMNPQLAPRLRFMVRDVIDLRSNNWVPRREEIKAKKISEIHSEAEKNLGLRPGAASGIRNGRSSPGGALLPGGAFPMNRPGTGGMMPGMPGSRKMPGMPGLDNDNWEVARSKSMPRGDSIRNQGPLLNKPSTVHKTSSINTRLLPQGSGAGLIGKSALLGTGAPPSRPLSFGPGPTPAQTTPKPIRAAPAVVPAPDKQASAPKGNTAELQKKTIALLEEYFGIRILDEAHQCIVELQSPDYYPEIVKEAVNLALDKGTNFVDPLVRLLEHLYTKKIFKTQDLESGCLLYGALLDDIGIDLPKAPTQFGEIIARLTLLGALRFEVMEEILKKMEDTMYRKAVFDAVKKTLEANPSGQTILGSHAAVIDACNSLLE

SEQ ID NO: 10250 - protein, 130 aa, Synechococcus sp. PCC 7942
MLLSHPDRQALKALDHQLSNRFIKLDPEGYFVIYLDREAGLICADHYSNAINDKGLATDPETGEVLACKGNLKRIPTATFRGRTAKELGKLITEDTQPCPLSYLDHALYLGREFQRAEACLLSGQDYVQD

SEQ ID NO: 10251 - protein, 394 aa, Novosphingobium aromaticivorans
MTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 10252 - protein, 317 aa, Listeria monocytogenes EGD-e
MYKNYLQRTLVLLLCFILYFFTFPLGGKAYSLNNWNKPIKNSVTTKQWMSALPDTTNLAALSIPGTHDTMSYNGDITWTLTKPLAQTQTMSLYQQLEAGIRYIDIRAKDNLNIYHGPIFLNASLSGVLETITQFLKKNPKETIIMRLKDEQNSNDSFDYRIQPLINIYKDYFYTTPRTDTSNKIPTLKDVRGKILLLSENHTKKPLVINSRKFGMQFGAPNQVIQDDYNGPSVKTKFKEIVQTAYQASKADNKLFLNHISATSLTFTPRQYAAALNNKVEQFVLNLTSEKVRGLGILIMDFPEKQTIKNIIKNNKFN

SEQ ID NO: 10253 - protein, 357 aa, Zea mays
  unsure (1)..(357): unsure at all Xaa locations
PKWVLLTVFCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISXPKXDAXMFVVGVNEDKYTSDVNIVSNASCTTNSLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDRVSTDFTGDSRSSIFDAKAGIALNDHFIKLVSWYDNEWGYSNRVVDLIRHMFKTQ

SEQ ID NO: 10254 - protein, 359 aa, ASPERGILLUS NIDULANS FGSC A4
MSTDYKFEGWLGLDAGSVDGKMQWKEFEPKPWEETDVDIKISHCGICGSDLHTLRSGWGPTNYPCCVGHEIVGTAVRVGSQVKHIKVGDRVGVGAQSESCVGRKGECNECATSNEPYCTKHFAGTYNGVFMNGGKSYGGYALYNRSPAHFAIKIPDAIPSAHAAPMMCGGVTVYSPLKHYGCGPGKTVGIIGIGGLGHFGVLFAKALGADRVVAISRKSDKRADALKLGADEYVATAEDTEWMANNKRSLDLIVCTVSSSKMPINDYVSLLKVDGTMIQVGAPEDGALTIPAFTLIANRVKLGGSLIGSPDTIREMLELAAEKGVKPWVEERPMKDANQAIKDMDAGDARYRYVLVNDH

SEQ ID NO: 10255 - protein, 464 aa, Borrelia burgdorferi B31
MDVGIYGLGVMGSNLALNIADNGFNVSVYNRDNEKTEIFVKQNSHKKINGFKDIESFVKSLKTPKKIILMVTSSAIEKVIEQILPFMNKSDIIIDGGNSHYKSTMRLEKELFAKDIYFVGLGISGGERGARFGPALMYGGSKSAYEILEPMLNKIAAKTKNNDICSTYIGENGSGHYVKMIHNGVEYADMQLISEVYFFMKKAFNLDNLKISEVFEKWNEGDLSGYLLEITSKILKYKENNEYLVDKILDIANQKGTGVWTAIDALESGVPVNLIVESVFSRFMSGLKHERIIASDLLKMDTSSFEFELSDWILDLYYALLVSKIVAYAQGFMMLKTASVNYGWDLNLGKISLVWREGCIIRSSFLDKIKLAYDKNPHLINLLFDDYFLDLLKNNHKSLRRIISKASEIGIPLPAFYASLSFLDSYSTNYLPSNLIQAQRDFFGAHSFERLDSKRGEFFHSAWQ

SEQ ID NO: 10256 - protein, 281 aa, Euglena gracilis
MDLDYEGQAPTTSLLLLFPPHLVPEYIGTISNNLRSAEVNHRPSKTFLEEVQVDITRLMRAILVDWMNEVTEEFRLKMETLCLAVNYVDRYLSRVPVPRHQLQLVGVASLLIASKMEEIMHPQIDEFVYITDSTYNREQVLRMELSILNALRYDMTVVTPRDFVGIYLKVAQASPEVCMLADYLLELILQEYAFLHWEPSMIAASAVVLALFGFRLPCWSDDLRRITQYQPNELNACLKEMHRVFQNAPHNNLQAVREKYSHGRFMHISMVAQLPPSPPVF

SEQ ID NO: 10257 - protein, 376 aa, Methanosarcina barkeri
MLYIHICGNKNTNVISDHQFIPLVFISVFCSILSWFSAVSQLTVPAGGFIMEILWLAQEEVINVIDMSSDMQVVERAFRQHGLGRVQMPPKSYLYYTAYNGDLRTMPAYLEEENITGVKIVNVHPGNPDRGLPTVMALIVLISPETGVPVAIMDGTYLTDVRTGAAGGIAAKYLARKDSKVIGLVGAGNQAKTQLKALCEVFEPELVRVTSSTKESSEQFIREMADTTPCEIRYEENIEKVCNCDILVTTTPTRKPIVKAQWIKEGTHINAIGADAVGKEELDPELLIRSKIIVDDIVQALHSGEVNVPLSKHYISENDIHAELGEVIVGLKPGRTSDEEITIFDSTGLAIQDVASAHLVYERAVSKGLGKQVLMF

SEQ ID NO: 10258 - protein, 225 aa, Zea mays
  unsure (1)..(225): unsure at all Xaa locations
ASVSLVLDPRPQKGRRVCHGVLATYXFDLVLDDVTRFLGETESEVVVLEVRTEFGHEDPPEFGRFLVERLGEHLLIPQDEAVFHKTVAELLPRRVICVWKPRRSPAPGPGEPLWSAGYLRDNWIDTDLPETKFESNLKFLGQQPPVAGRGFLYRVENTVTPRPDNPVVCVWPVTRRIHGYARMFIAEVFAKGLGDKLQVFSTDFIDGDFVDACAGVTKARVDGTA

SEQ ID NO: 10259 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSESSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETISGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNANGALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 10260 - protein, 141 aa, Bacillus cereus
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFD

SEQ ID NO: 10261 - protein, 318 aa, Pneumocystis carinii
FSATYNQDTLRSKEIESYLRQEQEHACHEAKILLLGAGESGKTTILKQMKLLHLSGLTLKEREYYRTIIFSNMLQSMRLIIEAMEEFDICVERRENEQYLDLLLQERELTNRENLPPEYYRPFISLWEDAGVTRAVNRGNEYALHDNCFYFFENIHRLFERKYTPTDQDILRCRLKTTGITETCFKVSRLTYRMIDVGGQRSERRKWIHCFENVTAVLFLVAISGYDQCLTEDIGANRMQEALVLFDSICNSQWFINTSIILFLNKIDLFKVKLHVSLISNYFPDFNNENQTDYRACCLFFRQKFLRLNRNHQKTIYT

SEQ ID NO: 10262 - protein, 280 aa, Zea mays
  unsure (1)..(280): unsure at all Xaa locations
MNLAALTSTAVRPHAHGLMPLNLPSAASSSLRRSLFASLRKKISPMASAPASASAALSTAAPADNGAAKPAEQRPVQVAKRLEKFKTTIFTQMSMLAVKHGAINLGQGFPNFDGPDFVKEAAIEAIKAGKNQYARGYGVPELNSAVAERFLKDSGLQIDPDKEVTVTSGCTEAIAATILGLINPGXDEVILFAPFYDSYEATLSMAGANVKAITLRPPDFAVPLEELKAAVSKNTRAIMINTPHNPTGKMFTREELEFIADLCXENDVLLFADEVYDQLA

SEQ ID NO: 10263 - protein, 349 aa, Aspergillus flavus
MSIPEMQWAQVAEQKGGPLIYKQIPVPKPGPDEILVKVRYSGVCHTDLHALKGDWPLPVKMPLVGGHEGAGVVVARGDLVTEFEIGDHAGLKWLNGSCLACEFCKQADEPLCPNASLSGYTVDGTFQQYAIGKATHASKLPKNVPLDAVAPVLCAGITVYKGLKESGVRPGQTVAIVGAGGGLGSLALQYAKAMGIRVVAIDGGEEKQAMCEQLGAEAYVDFTKTQDLVADVKAATPEGLGAHAVILLAVAEKPFQQAAEYVSRGTVVAIGLPAGAFLRAPVFNTVVRMINIKGSYVGNRQDGVEAVDFFARGLIKAPFKTAPLQDLPKIFELMEQGKIAGRYVLEIPE

SEQ ID NO: 10264 - protein, 79 aa, Glycine max
  unsure (1)..(79): unsure at all Xaa locations
MATAMIAWAAVTTADRADPRMHAPFTGLKSMAGFTTRKTNHDISSIATNAVRVLCMHEWTPVLMKKYETLYXLPDLDDP

SEQ ID NO: 10265 - protein, 462 aa, Bacillus subtilis subsp. subtilis str. 168
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 10266 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRNIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 10267 - protein, 615 aa, Saccharomyces cerevisiae
  unsure (1)..(615): unsure at all Xaa locations
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPXRSXTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIXEWSSSSXHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVXGKILLYDLQSREVKTSRWAFRTSKINAISWKPAEKGANEEEIEEDLVATGSLDTNIFIYSVKRPXKIIKALNAHKDGVNNLLWETPSTLVSSGADACIKRWNVVLE

SEQ ID NO: 10268 - protein, 247 aa, Streptomyces clavuligerus
MPSALQGKVALITGASSGIGEATARALAAEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVNVRNAAVYQATKFGVNAFSETLRQEVTERGVRVVVIEPGTTDTELRGHITHTATKEMYEQRISQIRKLQAQDIAEAVRYAVTAPHHATVHEIFIRPTDQV

SEQ ID NO: 10269 - protein, 342 aa, Glycine max
  unsure (1)..(342): unsure at all Xaa locations
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKXELDIVSNASCTNQLILLSIXRIINDRFGIVEGLMTTVHAITATQKGXDGPSNKDWRGGKSXASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 10270 - protein, 461 aa, Zea mays
MPPSKARRKRSLRDITATVATEPVANSKPGSSSTNKGKQQDKKKEGPQEPDIPPLPPVVVNIVPRQGLGCEVVEGLLVPSWKREYKPNSKYTVGNHPIYAIGFNFIDMRYYDVFAIASCNSVIIYRCLENGGFGLLQNYVDEDKDESFYTLSWTIDQVDSSPLLVAAGSNRIIRVINCATEKLNKSLVGHGGSIHEIRTHASKPSLIISASKDESIRLWNVHTGICILVFAGAGGHRHDVLSVDFHPTEVGIFASCGMDNTVKIWSMKEFWIYVEKSYSWTDHPSKFPTRNIQFPVLTAAVHSDYVDCTRWLGDFILSKSVKNAVLLWEPKPDKRRPGEGSVDVLQKYPVPKCSLWFMKFSCDFYSNQMAIGTNKGEIYVWEVQSSPPVLIDRLCNQECKSPIRQTAVSFDGSTILGAADDGAIWRWDEVDPAASSSKPDQSAAAAAGAGAGAGAGADADA

SEQ ID NO: 10271 - protein, 368 aa, Zea mays
MRRWLCCNCHYDVEEDDHAKEQAKAQSNKTDSKQKSSKPPGSQPEPEFSPPTIDVPELSLDDLKLKTDDFGSSALIGEGSYGRVYHATLDDGRQAAVKKLDASENEPNDEFLKQVSLASKLKHENLVEMLGYCVDGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPGTAEPAPQPVS

SEQ ID NO: 10272 - protein, 159 aa, Glycine max
SCTGVETVAQFGVVFLLFALGLEFSLAKLKAVGPVAVLGGLLQIIIFMFMCGILSMLFGAKLSEGVFVGSFLSMSSTAVVVKFLVERNSNNALHVQVTIGTLIFQDCAVGLLFALLPVLGGNSGLLQGIMSMGKLLLVLSLYITATSVLSWTFVPRFLK

SEQ ID NO: 10273 - protein, 251 aa, Burkholderia fungorum
MTQMALVIDLNVCVGCHACVTSCKEWNTSGESGSLADLNPYDADPSGTFFNRVQSFEAGSFPNAETIHFPKSCLHCEDPPCVPVCPTGASYKRKEDGLVLVDFDRCIGCKYCAWACPYGARELDEGRKEMTKCTLCVDRIHDQNLSERDRQPACVLACPTSARLFGDIHDPESVVSKAIEERGGYQLMPEWNTRPANHYLPRVPTEAASCGSGSCSCKTSGSVADPAQSPESLDAQLERGELHLASMATRI

SEQ ID NO: 10274 - protein, 502 aa, Oryza sativa (japonica cultivar-group)
MAAANGGDSKGFEVPKLEIKFTKLFINGRFVDAVSGKTFETRDPRTGEVIAKIAEGDKADIDLAVKAAREAFDHGPWPRMSGFARGRILHKFADLVEQHVEELAALDTVDAGKLFAMGKLVDIPGGANLLRYYAGAADKVHGETLKMARPCHGYTLKEPVGVVGHIVPWNYPTTMFFFKASPALAAGCTMVVKPAEQTPLSALFYAHLAKLAGVPDGVLNVVPGFGPTAGAAISSHMDIDKVSFTGSTEVGRLVMEAAAKSNLKPVSLELGGKSPVIVFDDADLDTAVNLVHMASYTNKGEICVAGSRIYVQEGIYDAFVKKATEMAKKSVVGDPFNPRVHQGPQIDKEQYEKILKYIDIGKREGATLVTGGKPCGENGYYIEPTIFTDVKEEMSIAQEEIFGPVMALMKFKTVEEAIQKANSTRYGLAAGIVTKNIDVANTVSRSIRAGAIWINCYLGFDPDVPFGGYKMSGFGKDMGMDALEKYLHTKAVVTPLYNTPWL

SEQ ID NO: 10275 - protein, 238 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAGNQDVAVNLIITDYCMPGMTGYDLLKKIKESSSLRDIPVVIMSSENIPSRINRCLEEGADEFFLKPVRLSDMNKLKPHILKSRCNQEQHQQSDSHSGECRNPTISSSSSSDSINNRKRKGAGTEEILPQLANRSRHS

SEQ ID NO: 10276 - protein, 337 aa, Synechocystis sp. PCC 6803
MTRVAINGFGRIGRNFLRCWLGRTDSQLEVVGINDTSDPRTNAHLLRYDSMLGKLDGDISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 10277 - protein, 326 aa, Rhizobium leguminosarum bv. trifolii
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAASRVISLDPNIRPGFIKDKPSHMARIKRMAAKSDIVKFSDEDLDWFGLQGDHDALAAHWLNHGAKLVVITKGAEGASGYTKDRKVTVPSERVTVVDTVGAGDTFDAGILASLKMDNLLTKRQVASLDEQALRNGPDPRRQSRRRHRLPRRRQSTLGARDWSLRLEQDSDPHPPDDTFSP

SEQ ID NO: 10278 - protein, 581 aa, Pseudomonas aeruginosa
MSDSCLPIAMVQSAQSHRPGTKPEIPALMQTVYTVLTLLLVVGATRLAAQLLPLPLPLIQIAAGALLALPSLGLHIALDPELFLFLFIPPLLFVDGWRIPKREVWGMRWPILMMAFGLVFFTVVGAGYFIHLLIPEIPLAASFALAAVLSPTDALAVSAITQGRLPKRLMHLLEGEALMNDASGLVAFKFAIAAAMTGVFSLVDASLNFLVVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 10279 - protein, 231 aa, Zea mays
  unsure (1)..(231): unsure at all Xaa locations
MGNPEKLMNQIFDLKFTSKSLQRQARKCEKEEKEQKLKVKKAIEKGNMDGARIYAENAIRKRTEXMNYLRLASRLDAVVARLDTQAKMQVIGKXMQSIVKSLDSALXATGNLQKMSETMDNFERQFVNMXEVQAEVHGGAPWPGSTSLSTPETEVNSLMQQVADDYGLGRAPVXGLPQAAAHAIPAAKEXREKVDEDDLSRRLAELKARGLRRVVSGFIRCDSWLMLVSPQ

SEQ ID NO: 10280 - protein, 131 aa, Flaveria ramosissima
SNGGRVQCMKVWPPLGKKKYETLSYLPNLTETQLAKEVDYLLRNKWVPCLEFELEHGFVYRENHRSPGYYDGRYWTMWKLPMFGCTDSSQVMKELGECKKEYPQAWIRIIGFDNVRQVQCISFIASKPDGY

SEQ ID NO: 10281 - protein, 355 aa, Callistephus chinensis
MVISANTRVESLATSGSDLIPKEYIRTHDELTTITNIFDEEKSDQGPQVPIIDLHDINSNDPKTRDKCTYELRKAATEWGVMHLVNHGISSDLINRVKAAGKSFFDQPVEEKEKYCNDIASGKIQGYGSKLANNACGQLEWEDYFFHLAFPEEKRDLSIWPTTPHDYIPATTEYAKQLRALATKILAALSLGLGLEEGRLEKEVGGMEELLVQLKINYYPKCPQPDVALGVEAHTDVSALTFILHNMVPGLQLFYGGKWVTAKCVPDSIIMHIGDTIEILSNGKYKSILHRGLVNKEKVRISWAVFCEPPKDKIILKPLPETISEDEPPLFPPRTFQQHMEHKLFRKNNDAVDPK

SEQ ID NO: 10282 - protein, 350 aa, Coptis japonica
MAFHGKDDVLDIKAQAHVWKIIYGFADSLVLRCAVELGIVDIIDNNNQPMALADLASKLPVSDVNCDNLYRILRYLVKMEILRVEKSDDGQKKYALEPIATLLSRNAKRSMVPMILGMTQKDFMTPWHSMKDGLSDNGTAFEKAMGMTIWEYLEGHPDQSQLFNEGMAGETRLLTSSLISGSRDMFQGIDSLVDVGGGNGTTVKAISDAFPHIKCTLFDLPHVIANSYDLPNIERIGGDMFKSVPSAQAIILKLILHDWNDEDSIKILKQCRNAVPKDGGKVIIVDVALDEESDHELSSTRLILDIDMLVNTGGKERTKEVWEKIVKSAGFSGCKIRHIAAIQSVIEVFP

SEQ ID NO: 10283 - protein, 365 aa, Rosa chinensis
MGSTGETQMTPTQVSDEEANLFAMQLASASVLPMVLKAAIELDLLEIMAKAGPGAFLSPNDLASQLPTKNPEAPVMLDRMLRLLASYSILTYSLRTLPDGKVERLYGLGPVCKFLTKNEDGVSIAALCLMNQDKVLVESWYHLKDAVLDGGIPFNKAYGMTAFDYHGTDPRFNKVFNKGMADHSTITMKKILETYKGFEGLTSIVDVGGGTGAVVNMIVSKYPSIKGINFDLPHVIEDAPQYPGVQHVGGDMFVSVPKGDAIFMKWICHDWSDEHCLKFLKNCYAALPDNGKVILGECILPVAPDTSLATKGVVHIDVVMLAHNPGGKERTEQEFEALAKGSGFQGIRVACNAFNTYVIEFLKKI

SEQ ID NO: 10284 - protein, 336 aa, Streptomyces avermitilis MA-4680
MSTPPFTPAPRRRAELLAAGAAAVTVVLWASAFVSIRSAGAAYSPGALALGRLLAGVLALGVICLVRGEGLPPRAAWPGIVMSGLLWFGCYMVVLNWGEQQVDAGTAALVVNIGPILIALLGARLLGDALSPRLLAGMAVSFAGAVAVGLSLSGEGGSSVLGVVLCLLAAAGYAGGVVAQKPALGSASALQATTFGCLVGAVGCLPFAGQLVHEAAAAPVSATLNMLYLGVFPTALAFTTWAYALARTTASRMGATTYAVPALVVLMSWLVLDEVPGPLTLAGGLLCLAGVAVSRSRPRGRTTAPVPEDTAPAPAPEPAPRPAPDPVPRPAPEPRA

SEQ ID NO: 10285 - protein, 295 aa, Bacillus subtilis
MRKKVRKAVIPAAGLGTRFLPATKAHKEMLPVVDKPAIQYIVEEAVESGIEDILIITGRKQRCIEDHFDRSAELEFNLREKGKTETLKEMQQIADLANIHYIRQKEPLGLGHAVLCAEHFIGDEPFAVLLGDDIMVSEKPALRQLMDVYAAYGTEVARRTACSPEDVSKYANIQTSGSQGHVYEVNDLVEKPSPEEAPSEIAVMGRYVLNPSIFPILKSIGRGAGNEIQLTDAFVRLRTQPIHARLLEGKRYDIADKLGCFKASTEIGLMRPEMRSQLLAYLEEVLKRETKEVLR

SEQ ID NO: 10286 - protein, 321 aa, Pseudomonas sp. SK-1-3-1
CIGCHTCSITCKNVWTSREGMEYAWFNNVQSKPGNGFPKKWENQDKWKGGWVRNSNGSIKPRIGGKFPLLANIFANPDLPSLDDYYEPFDFDYQHLHTAPLGEHQPGTRPRSLVSGKRMEKIEWGPNWEEILGTEFAKRRKDKNFDQIQADIYGEYENTFMMYLPRLCEHCLNPACAASCPSGAIYKREEDGIVLIDQEKCRGWRMCISGCPYKKIYFNWKSGKSEKCIFCYPRIEAGMSTVCAETCVGRIRYLGVLLYDADRISEVASTANEQDLYEKQLEIFLDPNDPAVIRQALADCVPQSVIDSAQRSPVYKMAVDW

SEQ ID NO: 10287 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 10288 - protein, 324 aa, Xanthomonas campestris
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHEKHGAPAKEIIRSALAAADARVSVRLAVLQRTAPLAPFWVRALEEWCHA

SEQ ID NO: 10289 - protein, 765 aa, Salmonella typhimurium
MKWLCSVGVAVSLAMQPALAENLFGNHPLTPEARDAFVTDLLKKMTVDEKIGQLRLISVGPDNPKEAIREMIKDGQVGAIFNTVTRQDIRQMQDQVMALSRLKIPLFFAYDVVHGQRTVFPISLGLASSFNLDAVRTVGRVSAYEAADDGLNMTWAPMVDVSRDPRWGRASEGFGEDTYLTSIMGETMVKAMQGKSPADRYSVMTSVKHFAAYGAVEGGKEYNTVDMSSQRLFNDYMPPYKAGLDAGSGAVMVALNSLNGTPATSDSWLLKDVLRDEWGFKGITVSDHGAIKELIKHGTAADPEDAVRVALKAGVDMSMADEYYSKYLPGLIKSGKVTMAELDDATRHVLNVKYDMGLFNDPYSHLGPKESDPVDTNAESRLHRKEAREVARESVVLLKNRLETLPLKKSGTIAVVGPLADSQRDVMGSWSAAGVANQSVTVLAGIQNAVGDGAKILYAKGANITNDKGIVDFLNLYEEAVKIDPRSPQAMIDEAVQAAKQADVVVAVVGESQGMAHEASSRTNITIPQSQRDLITALKATGKPLVLVLMNGRPLALVKEDQQADAILETWFAGTEGGNAIADVLFGDYNPSGKLPISFPRSVGQIPVYYSHLNTGRPYNPEKPNKYTSLYFDKPNGPLYPFGYGLSYTTFTVSDFTLSSPTMQRDGKVTASVKVTNTGKREGATVIQMYLQDVTASMSRPVKQLKGFEKITLKPGKRKTVSFPIDIEALKFWNQQMKYDAEPGKFNVFIGVDSARVKQGSFELL

SEQ ID NO: 10290 - protein, 303 aa, Bacillus cereus ATCC 14579
MPYFYVFLLLLTSLLWGGNFVVGKSLVDHASPMTLTNLRWMIAIVCLLPMVWFKEKKILPPRTAILPLILMGISGVALFNIFQFLALEKTSATNVGLISTLNAISIALFSVLFLKEKVNTLQILSMILSFFGVILVLLKGDFSLLFSLHFNSGDLWMIAAVCIWGIYSVCSKWATKTTTPLMATLYSGIFGVILLLPFNIGSFTVSNINTSFITSLLYTGLISTVLCMVFWNIGVQKLGATTSGIFLNFNPIFTAILAFIFLGEELTWIQILGTIVVVTGCYLFSHFKTVAVQPVRPLMRKHS

SEQ ID NO: 10291 - protein, 369 aa, Rhodospirillum rubrum
MSVLSQDRPRERPPMLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 10292 - protein, 374 aa, Triticum aestivum
SNECDELSIPAHLMTGTSQELFDFIAAALAKFVASEGEDFHLLEGRQRELGFTFSFPVKQSSIASGTLIKWTKGFSIDETVGADVVAELSSALDRQGLDMKVTALVNDTIGTLAGGRYDDNDVVAAVILGTGTNAAYVERANAIPKWHGLLPKSGDMVINMEWGNFRSSHLPLTEFDQALDTESLNPGEQIYEKLISGMYLGEIVRRVLLKMTEEASLFGDDIPPKLKIPFILRTPHMSMMHHDTSADLRTVGAKLKDVLGIQGTSLKTRRLVVAVCDIVAKRGARLAAAGIHGVLKKLGRDIPGSDKHRTVIAMDGGLYEHYTIFSETLENTLREMLGEEVSSSVVIKLANDGSGIGAALLAAAHSQYLEAEV

SEQ ID NO: 10293 - protein, 308 aa, Zea mays
  unsure (1)..(308): unsure at all Xaa locations
MSFSAARVSEHGGEFEEARGMPAEVSWEMLDKSRFFVLGAALFSGVSAALYPAVVLKTHLQVAAPAQAAASAAAAAILRRDGPRGFYRGFGASLAGTVPARALYMAALEATKSVVGSAALRLGVAEPAASAAASAAGGVSAAVAAQVVWTPVDVVSQRLMLQTAPLAAARYRGGTDAFRKILLADGVRGLYRGFGISVLTYAPSSAAWWASYVTAQRLLWRAVGPAAHDSRGAAIALQGASAAAAGSAAALVTMPLDTVKTRXLQDMDAGAQAPTLAAAARXALVREGGWSACYRGLGPRWAIMSLSL

SEQ ID NO: 10294 - protein, 481 aa, Helicobacter pylori J99
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 10295 - protein, 179 aa, Methanothermobacter thermautotrophicus str. Delta H
MMNMKSQSMEEHRASAPEDISCGVITLSDSKYREFQETGEIPESDTSGRLLVDALSHDYSVSEYTVIPDDGEKLISTIHDMIDEGVSVIFTTGGTGIGSRDITVETLRGIFEKELDGFGEIFRYLSFKELGAGAILSRATAGVYRGTLIFALPGSPNAVKLGIEIVVPEIGHLVKHLRE

SEQ ID NO: 10296 - protein, 292 aa, Haemophilus influenzae Rd
MQDLIKRTLPQDDALNQAIVNDLRSQNWAGFLNYSQVQQLCHNFELTTLKLAMHLLPLAASYSHTAISHFNVGAIAIGEQGDFYFGANQEFANSAIQQTIHAEQSAISHAWLRNERRISDMVVNYTPCGHCRQFMNELHGAEKISIHLPHSQNNPLHSYLPDAFGPKDLDIAAHLLAEENHDLVADHQDDLVNQAILAANQSHCPYSNSPHGIAILFKNSDVVTGRYAENAAFNPSLPALQTALNFAYLNDKKLSDIERIVMAEKALKLSHKTMAETLLSTLTSVELEYYSL

SEQ ID NO: 10297 - protein, 172 aa, Clostridium perfringens str. 13
MSLKDKIRVIEDFPKKGISFKDITTLIADGEGLRDSVDQMAEFFKDKNIDVVVGPEARGFIFGVPVAYALGVGFIPVRKPGKLPGDTVRVEYDLEYGKDALEIHKDAIKPGMRVAIVDDLLATGGTIAAVAKLVEQAGGEVAGLAFTIELTELKGRDKLKGYEVTSLVDYDV

SEQ ID NO: 10298 - protein, 396 aa, Oryza sativa (japonica cultivar-group)
MALRPNDVTLRLTPPLAAAARRNRRAAAGGVRVYAVASGAVSTKVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKAGTLPFSWVYGREVQL

SEQ ID NO: 10299 - protein, 473 aa, Zea mays
MATTAVSVDEKLDKLRAEVAKLSQISENEKAGFISLVSRYLSGEAEQIEWGKIQTPTDEVVVPYDILASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLVAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 10300 - protein, 419 aa, Grateloupia elliptica
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTC

SEQ ID NO: 10301 - protein, 525 aa, Brassica rapa subsp. pekinensis
  unsure (1)..(525): unsure at all Xaa locations
MPLTEXIYNHLSLFDLSLALLGLFVFCCLREKLTNKHGPMLWPVFGITLEFFIHKNDVYAWVTKSLKKSRNTFLYRGFWLDGSHGAVTCSPANVEYMLKTNFKNFPKGTFFKDRFKDLLEEGIFNADDESWKEQRRVIITEMHSTRFMEHSFQTTQRLVRKKLLKVMESFARSQEAFDLQDVLLRLTFDIICIAGLGDDPETPAQDLPQVPFAKAFDEATESTLFRFMIPPFIWKPMRFLDIGYEKGLRKAIDVVHGFVNKMIMDRICMVNDDETLDNRSVLTRIIQIESHKKGNEIGPSTIRFFRQFCTSFILAGRDTSSVAISWFFWVIQRHPQVENKIIQEIREILKQRGDPSDSSLFTVRELNNMVYLQAAISETLRLYPPIPMEMKQAIEDDMFPDGTFIKKGSRVYFSIYAMGRMESVWGKDCEDFGPERWIHAGKFVSGDQSKYVVFNAGPRLCLGKTFAYLQMKMIAASVLLRYSIKVAQDHVVVPRVTTNLYMKYGLKVTITPRSLEEKILESFHM

SEQ ID NO: 10302 - protein, 61 aa, Glycine max
RTITLLKRLGDGNKPAAIIGDVADDLNLDLVVISMEAIHTKHIDANLLAEFIPCPVMLLPL

SEQ ID NO: 10303 - protein, 757 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHISKGAWTFSDRDHGWQVSDCTAEALKCCLLLSMMSADIGGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLTPLHRAAKLIINSQLENGDFPQQEIVGAFMNTCMLHYATYRNTFPLWALAEYRKVVFIVN

SEQ ID NO: 10304 - protein, 495 aa, Eremothecium gossypii
MGFQSFKPTFRNEDLVRRGAYINGEWITSAKESFNVTDPATDQVIAELPDFDSGEAEAALKAAHASFQSYKKTSPTQRSEWLRNLYDLIMENAEDLAAIVTWENGKSLREALVEIRYGATFFKWFSEEALRLYGTTIQPSNPGNRAFTIRQPVGVCALICPWNFPNAMISRKAAPALAAGCTVIIKPDPQTPLSSLALAHLAEKAGFPPGVINVVPTSKYTKDIGVLLCESSLVRKVSFTGSTAVGKILMQQAASTVKKVSFELGGNAPVIIMGDADMEKTVEEVLATKFRGMGQTCICANRLYVHRSIIDDFSSRLVKKVEGLKLGNGFQEGVTHGSLINNAAIEKVERHAKDAIERGAKVLLPGGRAPELGPHFYSPTVLSDVKPDSVLTREETFGPLCAMIPFDTVEEVVGYANDTQYGLASYVFSENIKTVYSIAEALDFGMVACNTGLFSDSMVPFGGIKESGFGIEGSLHGINDYTVLKTVTIGNVPTL

SEQ ID NO: 10305 - protein, 148 aa, Zea mays
MCLVSFALFYLLVQIYILNKWQLKAFEYISLFVPVQVAQKNSLDIDVDLALGFAAHYGKIETMGCLVEEGNAIGFLGPLMRAAERGCLQVVEWFVNHGCREMELCLALTAATSNSQIAVAAYLLPLVPQHVLAPLSIEIIKAAGERTT

SEQ ID NO: 10306 - protein, 314 aa, Microbulbifer degradans 2-40
MKMNNSVAVIGESMLELMRAESDSSCRSMPAMLSYGGDTLNSSVYMSRLGAKVEYITAVGKDKNSEWLVKQWQSEGVGTRFVRTDEKKVPGLYMVTNDESGERYFTYWRNDSAARYIIDSEEKKQALYADLEGFDWIVISGISIAILDEASKKRMYELLQQCKARGAKIAFDGNYRPALWESKEQTRQAYQTVTAFADIILPTIDDEFQLYGEEPKDEVIDRLLSYGAKEIVLKMGGEGCYTVADNERTLVPGRKVVVVDTNSAGDSFNAGYLTGRMQGMSVEESALRGHLLASTVVQYRGAIIPKTAMPKMVG

SEQ ID NO: 10307 - protein, 202 aa, Magnetospirillum magnetotacticum
MASAADHASFLPPVLTFLSAAVIGVPLVRLLGQSAVLGYLVAGVVIGPAGFSLIAEPETAASVAEIGVVLLLFIVGLELEISRLVSMRRDIFGLGTAQLALCALVIAGAAFAYGLTPAAAGVVGIAIALSATAVALQLLEERGDLGSAYGGRSFAVLLFQDISVVAILAAVALLASGGATRKKGGRRRPPSPARAGWRDPRG

SEQ ID NO: 10308 - protein, 74 aa, Oryza sativa
GTLALEDALSTGSPIRTEVDQLRKSLEGIDKDSLLELALSSIPEVFSIRHFSLIPAGGGGMLTHAVAHVASSIK

SEQ ID NO: 10309 - protein, 203 aa, Aquilegia alpina
KRRNGLLKKAYELSVLCEAEVALIVFSSRGRLYEYSNNSVKKTIERYKKASTDSNNSGSVSEANAQFYQQEATKLRNQIASLQNHNRNLLGESLSNLNIRELKQIEKKIEGGISKIRAKKNELLFAEIEYMQKRELDLQTDNKYLRAMIAANERAPEHMNLMPANEYHALSSAPFDSRNFMPANLLDHNNNYSRSDQTTLQLG

SEQ ID NO: 10310 - protein, 404 aa, Spinacia oleracea
MESRVLSRTTAIAALPKLFRPSREAASFGFATGVKTPVGLVKDGGSLTWGRQLRPVLLLEPVQTGPVCSRREKTAVQPCRAASGSSGEAKTGFLEKYPALVTGSFFFMWYFLNVIFNILNKKIYNYFPYPYFVSVIHLFVGVVYCLASWSVGLPKRAPMDSKLLKLLIPVAVCHAIGHVTSNVSFAAVAVSFTHTIKALEPFFNAAASQFVLGQSIPITLWLSLAPVVIGVSMASLTELSFNWLGFISAMISNVSFTYRSLYSKKAMTDMDSTNIYAYISIIALFVCLPPAIIVEGPQLMKHGFNDAIAKVGLTKFISDLFWVGMFYHLYNQLATNTLERVAPLTHAVGNVLKRVFVIGFSIIAFGNKISTQTAIGTSIAIAGVALYSLIKAKMEEEKRQMKST

SEQ ID NO: 10311 - protein, 402 aa, Geobacter metallireducens
MISIEEAQQIILSHTGLLGTEEVPLLHALHRVIAEDVHAPWDIPGADHSAMDGYTFAYDDVQGGSLEVCGFLPAGVAPTEPVSPGCAMKIMTGAPIPPGCDTVVPVEDVLEEGTTIRLRGMVKRGDHIRRRGEEVNAGDLVVASGSLLRPPEIGILSSLGKTTATVFRKARVAVLSTGDELLQPGSIPEPGKIINSNSTSIAAQLLEAGAEPLMLGIARDDLETTRRKISDGLQADLLVTTGGVSVGDRDFVRDALLDLGGEIKFWKVAMKPGKPVAFAMVRGKPVFALPGNPVAAMVAFEQFVRPALLTMMGHARILRPVVRGTLEEAIRNRGGRPHFVRVSVRLEAGRYRLATTGDQGSARLSSLTSGNGLVKLPPDAAIVAGSEVEVQLLDRHFEMGHP

SEQ ID NO: 10312 - protein, 321 aa, Brassica juncea
MEKNIKFPVVDLSKLIGEERDQTMAWINDACENWGFFEIVNHGLPHDLMDNAPKKMTKEHYKKSMEQKFNDMLKSKGLEILEREVEDVDWESTFYLRYLPQSNLYDVPDMSDEYRTAMKDFGKRLENLAEDLLDLLCENLGLEKGYLKKVFHGTKGPTFGTKVSNYPACPKPEMIKGLRAHTDAGGIILLFQDDKVSGLQLLKDGDWIDVPPLNHSIVINLGDQLEVITNGRYKSVMHRVVTQKEGNRMSIASFYNPGSDAEISPASSLACKETEYPSFVFYDYMKLYAGVKFQPKEPRFEAMKNANAVTELNPTAAVETF

SEQ ID NO: 10313 - protein, 189 aa, Zea mays
  unsure (1)..(189): unsure at all Xaa locations
QRCIVNVCQPGSTHWAPRGCPGSSSVIFVLTVGTGVYVFTLDPMYGEFVLTVXPEEVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 10314 - protein, 435 aa, Bacillus anthracis str. A2012
MERRVPITVEEAVRKVMEFANEGLKELLPIELAYGRVLAEDLVADYDVPSFNRSPYDGFAIRAEDTNVASYETPIVFEVVGEIGAGSLFDEKVGPFQAVRIMTGAQIPNGCDAVVMLELTRQYEEAGSKYMELKRSFKAGDNISFQGEDARKGTVLAKKGTYINPGISALLATFGYSEVPVARKPVVGLLATGSELLDVNDSLQPGKIRNSNTYMILSQIRRAGGRVKYFGKFSDDFHTCFTAVKEALSQVDMLITTGGVSVGDYDYLPAIYEKLGASVLFNKVAMRPGSVTTVAQLNGKLLFGLSGNPSACYVGFELFVRPCIRTYMFSEKAHVKREKALLGEDFLKPNPFTRFVRGKLTYNEGQLIAYPSGFDKSSSVSSLAETNIFIVLPGGTRGYKKDMFVDVLLLEDNEGSEWPWTFYKVRGDSNGTSAI

SEQ ID NO: 10315 - protein, 483 aa, Pichia angusta
MSIDDKPLPADLAKEIETYKELFWVPTETLHKIIDYFIEELERGNADGTDPTGIPMNPAWVLEYPNGSETGDYLAIDLGGTNLRVVLAHLLGDHKFSTEQTKYHIPSHMRTTKNRDELFEFIAQCLEDFLKSKHPDGIPSDAVFPLGFTFSYPATQNSIFEGVLQRWTKGFDIPNVEGHDVVPLLMEQVEKKGLPIKIGALINDTSGTLVASRYTDELTEMGCIFGTGVNGAYYDRIKNIPKLKGKLYDDIDPESPMLINCEYGSFDNAHKVLPRTKFDIRIDDESPRPGQQSFEKMTSGYYLGELLRMIMLDTYKKGLIFKSYTESSEQIKNLETPYFLDTSFLSIAEADDTPSLSVVSNEFSNKLFIDTTFEERLYVRKLSQFIGTRAARLSICGISAVCKKMNYKKCHVAADGSVFLKYPYFPERAAQGLSDVFGWDGIDMKDHPIQIKQAEDGSGVGAAIIAALSHARREKGLSLGLKK

SEQ ID NO: 10316 - protein, 347 aa, Pseudomonas syringae pv. syringae B728a
MPQPRPYKVALNGYGRIGRCVVRALCERGAKAGFEVVAINDLADMASLEYLTRFDSTHGRFPGEVRVEGQYLHINDHRIKVLRSATPEGIDWAALEVDLVLECSGVYNTREDGQRFLDAGAPRVLFSQPMASERDVDATVVFGINQHKLTGRELLVSAASCTTNCSVPLLRLLDQAIGLEYMTITTIHSAMNDQPVIDAYHHEDLRRTRSAFQSIIPVSTGLARGIERLLPELAGRIQAKAVRVPTVNVSCLDITLQMSRDTDAVEINRILREAATSGPLKGLLAYTELPHASCDFNHDPHSAIVDASQTRVSGPRLVNLLAWFDNEWGFANRMLDVADHFLRVADQ

SEQ ID NO: 10317 - protein, 286 aa, Glycine max
MGSGKSKTVSSDVGYVPLDSGHARLRQLGYKQELNRHLSVISNFAFSFSIISVLTGVTTLYNTGLNYGGPVSFVYGWFIASGFTMLVALSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLLSQYTLTGFDASAHMTEETKDADRNGPTQNIMMKF

SEQ ID NO: 10318 - protein, 328 aa, Agrobacterium tumefaciens str. C58
MPSGPASAAGKEVAMLFISEEESATLVTHDLAFTAAWEALIAACDEATASFPVVLGHGSSTNNRFSVKAAATVELAGLKVGSYWPGNRDLGLSRHNSLILLFDQDTGRIGTAMEAGTVNAYRTAAADAVAADQLARRDAETLAIFGAGHQARYECMALARVRSLRRVMIVARNGEQAEEMRSALRQHGLNAEVAAPQNACAEADIIVTATSSRAPLFEADWVRPGTHVASMGSDARGKQELPPALFARGDLFCDLPEQARSIGEFQHAAPDLEVTALGDVLAGRRPGRSSDSAITIFDSSGLSLQDLYIARHLLAKRGAHETPLSANN

SEQ ID NO: 10319 - protein, 150 aa, Glycine max
SKEIIGNCVDLVFANGDEARALCNFEAKESAASAARYLSHFVPLASVTDGPTGSYIGVKGEAVYIPPSPCVPVDTCGAGDAYASGILYGLLRGISDLRSIGSLAAKVAATVVGQQGTRLRISDAVKLAESFEFQLDSSSSVGTDHNISSV

SEQ ID NO: 10320 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 10321 - protein, 218 aa, Zea mays
  unsure (1)..(218): unsure at all Xaa locations
MRLLLRRRRRFPASETAAATMATAAAASTALTGATTAAPKARRRAHLLATRRALAAPIRCSAASPAMPMAPPATPLRPWGPXSPRKGADILVESLERCGVRDVFAYPGGASMEIHQALTRSPVIANHLFRHEQGEAFAASGYARSSGRVGVCIATSGSGATNLVSALADALLDSVPMVAITGQVPXRMIGTDAFPETPIGEVTRXITKHNYLGLDVDD

SEQ ID NO: 10322 - protein, 479 aa, Streptomyces coelicolor A3(2)
MPASRVKSPHLLVAESGADREGHGLKRTMGLFQLVCFGVGAIVGTGIFVGLSDSVAEAGPAVVVSFVLAAITCVFTAFAFAELGGAIPVSGSSYSFAYAGLGERTAFLVGWCLLLEYGVSVSAVAVGWSQYVNELLDTVLGVQLPHALSAGPGDGGAVNLPAVVVIALASVLLMRGVRESARATAAMAVLKLAVLLAFCAIGFYAFQDGNLTPFSPAGLGGIGAGTTAAFFSYIGFDAITTAGEEAKNPRRDIPVAILVCIGLVTLLYCAVAVAAIGAVGGDQVGNRPAALSYVVDRVTGSAIGGGVVAFGAVVAIASVVLAVMYGQTRILMSMSRDGLIPRVFEKVSPRTATPVAGTLIVGVVFALPAAFAPLDAVVNLCTIGTLATMAAVNVSVITLRRREPGLARTFRVPLYPATPLLGVGFCLYLMYETGGATWLQFAVFLAVGLLVYSAYGRRHSRLARTAVSADDAERVPQEA

SEQ ID NO: 10323 - protein, 315 aa, Actinobacillus pleuropneumoniae serovar 1 str. 4074
MSQLDALREMTVVVADTGDIEAIKQYQPQDATTNPSLILSASALPQYASLIDDAVAYAKARSDDKAQQLIDAEDKLAVNIGLEILKIVPGRISTEVDARLSYDTKATIEKARQIMKLYNDAGISNDRILIKIASTWQGIRAAEVLEKEGINCNLTLLFSQAQARACAEAGVYLISPFVGRILDWYKAAEKKEYAPAEDPGVISVTNIYNYYKQYGYQTVVMGASFRNVGEITEIAGCDRLTIAPPLLKELAESNAPLVRKLEYKGEVKTRPAPLTEAEFYWQHNQDPMAVEKLAEGIRKFAVDIEKLEAMLAAKL

SEQ ID NO: 10324 - protein, 393 aa, Arabidopsis thaliana
MALSRLSSRSNTFLKPAITALPSSIRRHVSTDSSPITIETAVPFTSHLCESPSRSVETSSEEILAFFRDMARMRRMEIAADSLYKAKLIRGFCHLYDGQEALAVGMEAAITKKDAIITSYRDHCTFIGRGGKLVDAFSELMGRKTGCSHGKGGSMHFYKKDASFYGGHGIVGAQIPLGCGLAFAQKYNKDEAVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQVRDPIERVRKLLLTHDIATEKELKDMEKEIRKEVDDAVAQAKESPIPDASELFTNMYVKDCGVESFGADRKELKVTLP

SEQ ID NO: 10325 - protein, 165 aa, Triticum aestivum
LSPSTAMGGGNDGHGYPPGGQGGYPPQGYPPQQGGYPPQQGYPPAPGAYPPAPGAYPPAPGAYPPAPRGGEKGETAKKGLPLQHHARVLPVLHGGWPWLPIWWARGTPRSSMDTQHGYPPQQHGYPPQQHGYPPAGYPGSSGHSGSHGGGGMGMGGMLAGGAAAA

SEQ ID NO: 10326 - protein, 196 aa, Glycine max
MGSGKSKTVSSDVGYVPLDSGHARLRQLGYKQELNRHLSVISNFAFSFSIISVLTGVTTLYNTGLNYGGPVSFVYGWFIASGFTMIVALSMAEICSSYPTSGGLYYWSAKLAGPRWAPFASWITGWFNIVGQWAATTSVDYSLAQLIHVIILLTTGGKNGGGYEASIYVPIAVHGGMLLLHGMINRLPISLISFLG

SEQ ID NO: 10327 - protein, 495 aa, Schizosaccharomyces pombe
MAFSLVSILLSIALAWYVGYIINQLTSRNSKRPPIVFHWIPFVGSAVAYGMDPYVFFRECRAKYGDVFTFVCMGRKMTAFLGVQGNDFLFNGKLADLNAEEAYSHLTTPVFGKDVVYDIPNHVFMEHKKFIKSGLGFSQFRSYVPLILNEMDAFLSTSPDFGPGKEGVADLLKTMPVMTIYTASRTLQGAEVRKGFDAGFADLYHDLDQGFSPVNFVFPWLPLPRNRRRDRAHKIMQKTYLKIIKDRRSSTENPGTDMIWTLMSCKYRDGRPLKEHEIAGMMIALLMAGQHTSAATIVWVLALLGSKPEIIEMLWEEQKRVVGENLELKFDQYKDMPLLNYVIQETLRLHPPIHSHMRKVKRDLPVPGSKIVIPANNYLLAAPGLTATEEEYFTHATDFDPKRWNDRVNEDENAEQIDYGYGLVTKGAASPYLPFGAGRHRCIGEQFAYMHLSTIISKFVHDYTWTLIGKVPNVDYSSMVALPLGPVKIAWKRRN

SEQ ID NO: 10328 - protein, 465 aa, Nannochloropsis oceanica
YAEMGYWDANYTIKDTDVLALFRITPQPGVDPIEAAAAIAGESSTATWTVVWTDLLTACDVYRAKAYKVDSVPGTSDQYFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLVGSVIIMIDLVIGYTAIQSMAVWSRKNDMILHLHRAGNSAYARQKNHGINFRVICKWMRMAGVDHIHAGTVVGKLEGDPLMVKGFYNVLLQTSLDINLPQGIFFEQDWASLRKTLPVASGGIHCGQMHQLLNYLGEDCVLQFGGGTIGHPDGIASGATANRVAMESVLLAKYEGKDYINEGPKILRAAAESCAPLRSALDLWKDIAFNYTSTDTADYIETATKQ

SEQ ID NO: 10329 - protein, 255 aa, Candida boidinii
MSEINETIGENPQPVEHHEPAPLQHEEQQQQQNHDQDQDQRQQQQNLAQQQQELEEKQKELQIQLEQQQQAGISEDDQELAILKAKMEEMKQEANALREMQEQMGNNGTHPHLDLAARQDIDNRSVYIGNLDYAATPDELQKHFESCGSINRITIPTNKFTGNPKGFAYIEFSDASYVPQALSLNDSLFKGRNLKISAKRTNVPGFSRGRGGPMRGGFRGGRGGFRGRGGFRGGRGGGFRGRGGFRGGRGGFQPY

SEQ ID NO: 10330 - protein, 409 aa, Rhodobacter sphaeroides
MRDAQRPDLSTTFTVLLAGGRGSRLHELTSRECKPALPFAGPRRIVDFTLANAARSGLTRMIVATQYRPETLAHHLESRWASRFAGGSLRLREGTAVTGSPQGYGGTAAAVAANLAELQSEGVRELVVLAADHVYEMDYADMVAAHRASGASATVAVDTVPTDRASEFGVVRTSEGGRIESFLEKPAVVPADPAIPGRAQVSMGIYVFDLDWLASVLRIIPGATQDFGHDILPLAVALGEAHAYRVPGDNFYWRDVGTLDAYRLAQLEFQTGEAPCALPPRIAASEHEMKAATGELIQFAFRMQTGGIALHSPRLGGDLPGRWTMLDESVLLPGARVAPGVRLTRTIVAPGTSVPAGLVIGEDPDEDARWFRRTEEGTVLVTTPMLARRAADRGRLVAPFADSRMGRSA

SEQ ID NO: 10331 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 10332 - protein, 405 aa, Vibrio vulnificus CMCP6
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKLAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKIFHVSDDGIVVIPKGARVGY

SEQ ID NO: 10333 - protein, 160 aa, Oryza sativa
SRNHSFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 10334 - protein, 183 aa, Archaeoglobus fulgidus DSM 4304
MQDYKIKIENVVASTQIGENIDLNKISREIKDSEYKPKQFPGLVLRTKEPKAAALVFRSGKVVCTGSKSVEDARRAVKQIVKMLKEIGISVIDEPEVKVQNIVASADLGVDLNLNAIAIGLGLENIEYEPEQFPGLVYRLDNPRVVVLIFGSGKMVVTGGKSPEDARKAVERISEELRTLGLM

SEQ ID NO: 10335 - protein, 571 aa, Agrobacterium tumefaciens str. C58
MDTAVHETTVAERIAKALRRHDVEVIFGQSLPSAVILAAEKIGITQIAYRQENMGGAMADGYARRSGKIGIVAAQNGPAAALLVAPLAEALKASVPVVALVQDVERDQTDRNAFQDLDHIGLFQSCTKWVRRVSVEERIDDYIDAAFTAASSGRAGPAVLLLPADLLRSVSTTPSRRRTNNLGHWPLDRSRPADKDLDIAAKAIANARAPVVIAGGGIHASGAAQQLRLLQDECSIPVFTTNMGKGSVDEWHPLSGGVLASLVGPKSLGRHTVEIVREADLVVLIGTRTNQNGTDNWRQYSPDAQIIHIDTDPQEVGRNFEAIRLVGDARETLAGLRERIRLCDLHLRTVSREAVCNRLRESWRKFNDDRRGYYSSEASPLRPERIMAELQGVIDENTTVVADASYSSMWVLGQLRISSERTRVLTPRGLAGLGWGVPLAIGAKVAAPESDVVALVGDGGFAHSWAELETLVRMQIPITIIVLNNGILGFQRDAETVKFGKYTTACHFAEVDHVKIAHACGCDAVRVTQPQDLKAHMQKVKKRKLPLLIEAMTDPEAHPALSLFAQMDSAA

SEQ ID NO: 10336 - protein, 325 aa, Glycine max
  unsure (1)..(325): unsure at all Xaa locations
VGLIIIYLYTITQFETRSYPIYVCYEIKFREFKESTKVDKVVVLWTANTERYSNLVVGLNDTMENLFASLDRNEAEISPSTLYAIACVMENVPFINGSPQNTFVPGLIDLAIKRNSLIGGDDFKSGQTKMKSVLVDFLVXAGIKPTSIVSYNHLGNNDGMNLSAPQTFRSKEISKSNVVDDMVNSNAILYEPSEHPHHVVVIKYVPYVRDIKRAMDDNTSEIFIGGKNTIVLHNTCDDILLAAPIILDLLLLAELSTRIEFKADNEGKFHSFHPDATMLSYLTKATLVPPATPEVNALTKQRAMLEHILSAXVVLTSENNMILYY

SEQ ID NO: 10337 - protein, 466 aa, Gracilaria cervicornis
YAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARRNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLFDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 10338 - protein, 336 aa, Burkholderia fungorum
MQSIQLAIWVVTGLVAVALIFDFMNGFHDAANSIATVVSTGVLKPQQAVAFAAAFNVIAYFVFHLKVAATVGKGTIDPNIVDHYVIFGALVGAIGWNIITWHYGIPSSSSHALIGGLVGAALAKSGWGSLNVDGLMKTVAFIFISPLLGFVLGSFFMLAVSWIYFRTPPSKVDRRFRRLQLVSAGLYSLGHGGNDAQKTIGIIWMLLIATGYASSIADAPPLWVIGGCYLSMGIGTLFGGWRIVRTMGQKITKLKPVGGFCAESGGAITLFTASWLGIPVSTTHTITGAIVGVGATQKLSAVRWGVAGNIVWAWILTIPASAALAGVAWWLGHRFL

SEQ ID NO: 10339 - protein, 295 aa, Actinobacillus pleuropneumoniae serovar 1 str. 4074
MTKILGSDLIKRGMAQMQKGGVIMDVVNAEQARIAEAAGAVAVMALERVPSDIRAAGGVARMANTAIVREVMEAVSIPVMAKARIGHIVEARVLEAMGVDYIDESEVLTPADEEFHLLKSDYTVPFVCGCRDLGEALRRIGEGASMLRTKGEPGTGNVVEAVRHLRKVNAQLRKVINMSHDELMTEAKHLGAPFELLLQIKTLGKLPVVNFAAGGIATPADAALMMELGADGVFVGSGIFKSENPEKFAKAIVQATTHYQDYDLIARLSADLGEPMRGLEISELAVQDRMQERGW

SEQ ID NO: 10340 - protein, 469 aa, Brucella suis 1330
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEAAKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 10341 - protein, 469 aa, Porphyra mumfordii
  unsure (1)..(469): unsure at all Xaa locations
VIRYAKMGYWDADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGEIKGHYLNVTAATMEDMYERAEFSKVVGSIICMIDLVIGYTAIQSMAIWARKNDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDXXFNYTSTDTADFVETPTANV

SEQ ID NO: 10342 - protein, 332 aa, Zea mays
  unsure (1)..(332): unsure at all Xaa locations
MRPSVMRSAAQLLRRRNYSSASGQQARKVAILGAAGGIGQPLSLLMKLNPLVSSLSLYDIAATPGVAADVSHINSPALVKGFMADDQLAEALDGADLVIIPAGVPRKPGMTRDDLFNINAGIVKNLCTAIAKYCPNALVNMISNPVNSTVPIAAEVFKKAGTYDEKRLFGVTTLDVVRARTFYAGKANVDVNTVDVPVVGGHAGITILPLFSQATPSTNALSAEEIKLSPDRSGSRXGSATLSMAYAGAVFXADACLKGXLNGVPDIVECSFVQSTVTELPFFASKVRLGKNGVEEVLGLGELSDFEKEGLEKLKSELKSSIEKGIKFANDN

SEQ ID NO: 10343 - protein, 458 aa, Shigella flexneri 2a str. 301
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 10344 - protein, 202 aa, Hordeum vulgare subsp. vulgare
DNGEGGTFALYSLLCRHAKLSLLPNQQAADEELSTYYRDGFAAQHGSSPWLRRFLEKHKTVKTGLLVVVLCAASMVIGDGVLTPAISVLSSMSGLQVRATGLQERSVVLLSCIVLVGLFSLQHRGTHKVAFMFAPIVIIWLLCIGGIGLYNIVHWNPKIYQAISPYYIVKFFRTTGTDGWIALGGILLSMTGSEAMFADLGH

SEQ ID NO: 10345 - protein, 485 aa, Brassica napus
MKSFNTDQHGHSAAESGDVYAMSDPTKNVDDDGREKRTGTWLTASAHIITAVIGSGVLSLAWAIAQLGWIAGTLILIIFSFITYFTSTMLADCYRAPDPLTGKRNYTYMDVVRSYLGGRKVQLCGVAQYGNLIGITVGYTITASISLVAIGKANCYHNKGHHADCTISNYPYMAAFGIIQILLSQIPNFHKLSFLSLMAAVMSFAYASIGIGLAIATVAGGKVGKTNMTGTVVGVDVTAAQKIWRSFQAVGDIAFAYAYATVLIEIQDTLRSSPAENKAMKRASFVGVSTTTFFYILCGCLGYAAFGNKAPGDFLTNFGFYEPFWLIDFANACIAFHLIGAYQVFAQPIFQFVEKKCNRNWPDNKFITSEYSVNIPFLGKFSINLFRLVWRTAYVVITTLVAMIFPFFNAILGLIGAASFWPLTVYFPVEMHIAQTKVKKYSSRWIGLKMLCWVCLIVSLLAAAGSIAGLISSVKTYKPFRTIHE

SEQ ID NO: 10346 - protein, 193 aa, Phaseolus acutifolius
MVPSEIRGVHYLAPENPFLVPPNFGLLQNDIPNLHLNTLLSNFPNCHFPPSGLEFVAPHSCLSSNSTSDEADEIQFNIIDERKHRRMISNRESARRSRMRKQKHLDELWSQVVRLRTENHNLIDKLNHMSDSHDRVLQKNTRLKEEASDLRQMLADMQIGISFACTMEELEDLPCNKPGPSNQLITPADMIHE

SEQ ID NO: 10347 - protein, 478 aa, Aspergillus oryzae
ATPADWRSQSIYFLLTDRFARTDGSTTATCNTADQKYCGGTWQGIIDKLDYIQGMGFTAIWITPVTAQLPQDCAYGDAYTGYWQTDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGLPIIYAGQEQHYAGGNDPANREATWLSGYPTDSELYKLIASANAIRNYAISKDTGFVTYKNPYIKDDTTIAMRKGTDGSQIVTILSNKGASGDSYTLSLSGASYTAGQQLTEVIGCTTVTVGSDGNVPVPMAGGLPRVLYPTEKLAGSKICSDSS

SEQ ID NO: 10348 - protein, 758 aa, Taraxacum officinale
MWKLQLSKGDDDPEVRSVNHHMGRQYWEFDPHAGTPEEQSQIESMREEFTRNRLNVTHSSDLLMRFQLTSKNRGGIEKSHVKEEGGDDEVVVKTLKKALKFYSSLQGEDGSWPGDYGGPLFLLPGLIIGLHVMGMKDLVLSIEQQNEIRRYLYNHQNVDGGWGLHIEGNSTMLSTALNYVSLRLLGEELDDGKGAMTKAQSWILKHGSVTHIPSWGKLWLSVLGVYEWRGNNPLPPETWLLPYFLPLHPGRLWCHTRMVYLPMSYLYGKRFVGPISSIVLSLRRELYSTLYYQVNWDLARKQCAKDDLYYPHPLIQDLLWDSLNKIVEPLLMQWPVAKLRKEALKTVMQHIIMRMRTRTIFCIGPVNKVLNMLCCWVEDPKTPINKLHLSRIKDYLWVAEDGMKMQGYNGSQLWDVVFSVQAIVATNLVDEYSSMLHKAHDFIKNSQVKKNSSGNSQSWYRHISRGGWPFSTPDNGWPVSDCTAEALKTVLMLSQMPHDIVGEAIAPECLYDAVNVILSLQNSDGSFATYELTRSYSWLELVNPAETFGDIVIDYPYVECTSAVVQSLRSFTKLYPSHRRIQIETCIEKAIAFIERSQLGDGSWYGSWAICYTYGTWFGIKGLVAGGKTYETSHSIRKACAFLLSKQLHSGGWGESYTSCQQKTYTNLVGNKSHITNTSWALLALIEAGQPRRDRIPLHRAAKVLIDHQLGNGDFPQQEIIGVFNKNCMISYSSYRNIFPIWALGEYLNHVITKKSLG

SEQ ID NO: 10349 - protein, 448 aa, Bacillus pseudofirmus
MSNEREMQNKKDQQLESFRVEDEGKKLTTNQGLKVSEDEFSLKAGERGPTLMEDFHFREKMTHFDHERIPERIVHARGFAAHGEFQVYDSMKEFTKAKFLQDPSVKTPVFVRFSTVAGSKGSAETVRDARGFATKFYTEEGNYDLVGNNIPVFFIQDAIKFPDLVHALKPEPHNEIPQAQSAHDTFWDFIANNQESAHMVMWAMSDRSIPRSFRMMEGFGVHTFRFVNEEGKAHFVKFHWKPVLGIHSLVWDEAQKIAGKDPDFHRRDLWESIENGDYPEYELGVQLISEEDEFNFDFDVLDPTKIWPEEEVPVKIIGKMTLNRNVDNVFAETEQVAFHPGHVVPGIDFTNDPLLQGRLFSYTDTQLIRLGGPNFHELPINRPVCPFHNNQRDGYGRQTINKGQVSYHKNSLAANTPQPASEEEGGYAHYQEKVEGRKVRKRSESFKD

SEQ ID NO: 10350 - protein, 156 aa, Triticum aestivum
  unsure (1)..(156): unsure at all Xaa locations
MGGGNDGHGYPPGGQGGYPPAGYPPQQGGYPPQQGYPPAPGAYPPAPXAYPPAPGAYPPAPGAGGPDGEKGLLSNIMHGVAGAHGGGHGYPSGGHGYPSGGHGYPPQQGYPXQHGYPPQQHGYPSQQHGYPPGGYLGSSGHMVAMEEEHGIGRMLG

SEQ ID NO: 10351 - protein, 620 aa, Oryza sativa
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAECLASYITDDEIRKGILFPSISSIRHITARVGAAVVRAAVDEDLAEGRCDVDARDLKSMTEADTVDFVARKMWYPIYSPLVNDK

SEQ ID NO: 10352 - protein, 359 aa, Nostoc commune
MALVPLRLLLDHAAENGYGIPAFNVNNLEQIQAILKAAVETDSPVILQASRGARAYAGENFLRHLILAAVETYPHIPIVMHQDHGNAPATCYSAIKNNFTSVMMDGSLEADAKTPASFEYNVNVTREVVNVAHALGVSVEGELGCLGSLETGAGEAEDGHGFEGTLDHSQLLTDPDEAVEFVEATQVDALAVAIGTSHGAYKFTRKPTGEILAISRIEEIHRRLPNTHLVMHGSSSVPEDLLALINQYGGAIPETYGVPVEEIQKGIKSGVRKVNIDTDNRLAITAAVREACAKKPEEFDPRHFLKPSITYMQKVCAERYQQFGTAGNASKIKQISLEDFAAKYAKGELNVVTKAAAKV

SEQ ID NO: 10353 - protein, 303 aa, Cicer arietinum
GVALAGLLGTVRSQGRPLSDFVNQKIVVAGAGSAGLGVLKMAINAVAKISGCSETAAKSQFFLIDKNGLVTTERNNLDPAAAPFAQNPRDIDGLTEGASIVEVVKKVKPHVLLGLSGVGGIFNEEVLKAMRESVSTKPAIFAMSNPTMNAECTAIDAFNHAGEHIVFASGSPFENVDFGNGNVGHVNQANNMYLFPGIGLGTLLSGAHLITDGMLQAAAECLASYMSEEDILKGILYPSVDSIRDVTAEVGAAVLRAAVEEDLAEGQGDVGPRELAHMSKEETVEYVRRNMWFPVYSPLVHEK

SEQ ID NO: 10354 - protein, 200 aa, Oenococcus oeni MCW
ADKFQFHIWVTPVGPYYKGGMKPTEYVTSPYDRAAHGGTGQSKVSGNYAASLLPGSLAHKNGYSDVVYLDPRLHENIEELGGANFFGITKDGKFKTPKSPSILPSITKKSLLQIADSFGMEPEETTISIYDLDQFSEAGAMGTAAVISPVGSITHNGNKHVFYSETEVGSYTQKLYDRLSGIQDGDQKGPDGWQVDVPLK

SEQ ID NO: 10355 - protein, 540 aa, Sesbania rostrata
MAGGGGQLGVLNALDVAKTQWYHFTAIVIAGMGFFTDAYDLFCISLVTKLLGRIYYTDYNKPKPGVLPPNVQAAVTGVALCGTLAGQLFFGWLGDKLGRKKVYGITLMLMVVCSIASGLSFGSSAKGVMATLCFFRFWLGFGIGGDYPLSATIMSEYANKKTRGAFIAAVFAMQGFGIMAGGIVALIVSSAFDHKYKVPAYQEDAKASMVLPAFDYVWRIILMFGAVPAALTYYWRMKMPETARYTALVAKNAKQAASDMSKVLQVEIEAEEDKVQHLIESQNQTFGLFSKEFAKRHGLHLVGTTTTWFLLDIAFYSQNLFQKDIFTAIGWIPPAKEMNAIHEVYRIARAQTLIALCSTVPGYWFTVAFIDYMGRFAIQLMGFFFMTVFMFALAIPYHHWTLKENRIGFVVMYSLTFFFANFGPNATTFVVPAEIFPARLRSTCHGISAAAGKAGAIVGAFGFLYAAQSTDPAKTDAGYPTGIGVKNSLIMLGVINFFGIIFTLLVPESKGKSLEELSGETEEDGVEAIEAAASSRTVPV

SEQ ID NO: 10356 - protein, 177 aa, Photobacterium profundum
MSKAKIGIVTVSDRASAGVYEDISGQAIIDTLNDYLTSPWEPVYQVIPDEQDVIEATLIKMADEQDCSLIVTTGGTGPAKRDVTPEATEAVCDRMMPGFGELMRTESLKFVPTAILSRQTAGLRGDSLIVNLPGKPKSIRECLDAVFPAIPYCIDLMEGPFLECNEEVIKPFRPKQK

SEQ ID NO: 10357 - protein, 476 aa, Oryza sativa
  unsure (1)..(476): unsure at all Xaa locations
MDAAMESAVGPHFSGLRLDSRRLSSSSLPPSPLRAASNGCGGNDAPAALVPPSALRQPFVIGVSGGTASGMMTVCDMIIQQLHDHRVVLVNQDSFYRGLTAEESAHAQDYNFDHPDAFDTEQLLECMGQLKRAQPVNVPIYDFKNHRRSSESFRKVNASDVIILEGIXSLPCLMDLKIFVDTDADIRLARRIRRDTVERGRDVISVLEQYGRFVKPAFDDFVLPSKKYADVIIPRGGDNHVAIDLKWQLTXIVQHIRNDLCKIDLCKIDPHTTVVLRGMHTRGMHTHIPDRXDFVFHSDRLIRLVVEHGLGRSPCAVCQFLTPTGSPHLGPVIWELLCGVXIIRSGESMEKALRAWCKGIKIGKILIHRDGDKXGNQLIYHKFPLDIAERHVLLMDPVLGTGNSANQAIELLISSGVPEERIMFLNLISAPEGVHCVCKRFPRLKIVTSEIETGLNEEYRVIPGLGEYGDRYFGTD

SEQ ID NO: 10358 - protein, 401 aa, Arabidopsis thaliana
MWTLNVQVMDFPGGKVAFTPEIQFISESDKERVPCYRVLDDNGQLITNSQFVQVSEEVAVKIYSDMVTLQIMDNIFYEAQRQGRLSFYATAIGEEAINIASAAALTPQDVIFPQYREPGVLLWRGFTLQEFANQCFGNKSDYGKGRQMPVHYGSNKLNYFTVSATIATQLPNAVGAAYSLKMDKKDACAVTYFGDGGTSEGDFHAALNIAAVMEAPVLFICRNNGWAISTPTSDQFRSDGVVVKGRAYGIRSIRVDGNDALAMYSAVHTAREMAIREQRPILIEALTYRVGHHSTSDDSTRYRSAGEIEWWNKARNPLSRFRTWIESNGWWSDKTESDLRSRIKKEMLEALRVAEKTEKPNLQNMFSDVYDVPPSNLREQELLVRQTINSHPQDYPSDVPL

SEQ ID NO: 10359 - protein, 402 aa, Ferroplasma acidarmanus
MVESIEITDSRITKIFDSRGNPAIEATIILNYATGTSSAPAGASTGKTEVIAYPKNNIDNSVDFYNKHVRNALKGFNALNQSGFDTLLHELDGTDNFSEMGGNLATALSIANAKAVSNYLEIPLYRYVGGLHPQIPRPMGNIIGGGKHSKNGTTIQEFLVSSQGKTFYDSVYYNILVHRRVGEKLSEKLKGQSVGLGDEKAWTADVSDEEAIEIMKEAAGEISSENKVKIYLGVDFAADSFYNNGKYDYKTSKKTQDEQIDYAVSLNKEHGFYFIEDPLYDNDFEGFAEITKKIGEDSLIVGDDLYTTNSARIQKGIDMKSTNAVLIKVNQIGTLSDTVKSVKLATKNSMDTVVSHRSGETTDDFIAHLAVAFNSKFIKTGTIGGERLAKLNEVIRLEEDLI

SEQ ID NO: 10360 - protein, 153 aa, Zea mays; identical to SEQ ID NO: 9082

SEQ ID NO: 10361 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTDLFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKESKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGLPKGMDPSQLIMEEKFGLTLQKEPPLYIVPKTRD

SEQ ID NO: 10362 - protein, 582 aa, Streptomyces clavuligerus
MTEPGTDGVWRPLMSRVSTAPSRKPTAAHALLSRLRDHGVGKVFGVVGREASILFDEVEGIDFVLTRHEFTAGVAADVLARITGPPGVLATLGPGMTNLSTGIATSVLDRSPVIALAAQSESHDIFPNDTHQCLDSVAIVAPMSKYAVELQRPHEITDLVDSAVNAAMTEPVGPSFISLPVDLLGSSEGIDTTVPNPPANTPAKPVGVVADGWQKAADQAAALLAEAKHPVLVVGAAAIRSGAVPAIRALAERLNIPVITTYIAKGVLPVGHELNYGAVTGYMDGILNFPALQTMFAPVDLVLTVGYDYAEDLRPSMWQKGIEKKTVRISPTVNPIPRVYRPDVDVVTDVLAFVEHFETATASFGAKQRHDIEPLRPRIAEFLADPETYEDGMRVHQVIDSMNTVMEEAEPEGTIVSDIGFFRHYGVLFARADQPFGFLTSAGCSSFGYGIPAAIGAQMARPDQPTFLIAGDGGFHSNSSDLETIARLNLPIVTVVVNNDTNGLIELYQNIGHHRSHDPAVKFGGVDFVALAEANGVDATRATNREELLAALRKGAELGRPFLIEVPVNYDFQPGGFGALSI

SEQ ID NO: 10363 - protein, 212 aa, Schizosaccharomyces pombe
KARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKKFGYKTIVMGASFRNVGEIKELAGVDFLTISPALLEQLNNSTDAVPKKLDASKASSLNLEKVSYLTDEPKFRFDFNNDEMAVVKLSTGIAAFAKDADTLRTILKAKLEA

SEQ ID NO: 10364 - protein, 410 aa, Rhodobacter sphaeroides
MAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 10365 - protein, 492 aa, Nicotiana glutinosa
MDPYKYRPSSAFNSPFCTTNSGAPEKNNNSYLTVGARGLVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYAKFHWKPTCGVQSLLEDEAARVGGANHSHATQDLYDSIAAGNYPEWKLFIQTMDPSHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVILKENNFKQPGERYRSFTPDRQERFIRRWVEALSDPRITHEIRSIWISYWSQADKSLGQKLASRLNVRPSI

SEQ ID NO: 10366 - protein, 534 aa, Yarrowia lipolytica
MVHLGPRKPPSRKGSMADVPRDLLEQISQLETIFTVSPEKLRQITDHFVSELAKGLTKEGGDIPMNPTWILGWPTGKESGCYLALDMGGTNLRVVKVTLDGDRGFDVMQSKYHMPPNIKVGKQEELWEYIAECLGKFLADNYPEALDAHERGRDVDRTAAQSFTRDKSPPPHNQHISCSPGFDIHKIPLGFTFSYPCSQPAVNRGVLQRWTKGFDIEGVEGEDVVPMLEAALERKNIPISITALINDTTGTMVASNYHDPQIKLGNIFGTGVNAAYYEKVKDIPKLKGLIPDSIDPETPMAVNCEYGAFDNEHKVLPRTKWDIIIDEESPRPGQQTFEKMSAGYYLGELLRLVLLDLYKDGFVFENQGKNGQELGNGNINKSYFFDTSFLSLIEEDPWENLTDVEILFKEKLGINTTEPERKLIRRLAELIGTRSARISACGVAAICKKAGYKEAHAGADGSVFNKYPGFKERGAQALNEIFEWNLPNPKDHPIKIVPAEDGSGVGAALCAALTIKRVKQGLPVGVKPGVKYDI

SEQ ID NO: 10367 - protein, 432 aa, Bifidobacterium longum NCC2705 [sequence omitted]

SEQ ID NO: 10368 - protein, 220 aa, Chloroflexus aurantiacus
MYKTVGEATTLVRDLLAGLGELSDREAIVCPPFTALAAVALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGAL

SEQ ID NO: 10369 - protein, 454 aa, Staphylococcus xylosus
PSGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 10370 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 10371 - protein, 210 aa, Papaver somniferum
MSIIPSFFSNQRSNVFDPFSLDIWDPFQGFPFSTGALTANWQGGSDTARETSQLANTRIDWKETPEAHVFRADLPGVTKEEVKVEVEEGRVLQISGERRSRESEEKNDKWHRVERSSGKFLRRFRLPENTKMDEVKATMENGVLTVCVPKVEQRRPEVKSIEISGASEGSTQVPMETPVLRLHKTRLLRDVAMTGNLQASYVVSCLVLFS

SEQ ID NO: 10372 - protein, 486 aa, Burkholderia fungorum
MTTLTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLCVGGI

SEQ ID NO: 10373 - protein, 400 aa, Desulfitobacterium hafniense
MSEDTNLFITRGEALELLSSSWNPEQEREWVSLKDALGRVTAKPLYSQNTMPVYRISQLDGIAVRSSDFMNGIPDTSGWVKGVDYVQADTGDDFPDEFDTVIPVEDTHYDSDGRLSLAKGLTLKAGDCVGAAGTAVRQGDLIADAQVRLTPLHLSMLALSGIYHLEVLRKPRVIYIPTGSELITAGIRPERGQTIESNSLMVTALLEQWGADVTCYPIIKDKPEELAEALDKALQAADLVLINGGSSKGAEDFNTALLRKRADLFRHGVRAIPGRPVGMAIIAGKPVINMPGPTFATFLAMDWCVSGLVHHYYGLPAPQRPKVKVSLTKALEKRPDYEFYFRLMVTGKDGGYEATPLGWDRNLPDSLLKMDAILIVPIGVAGYQAGEEVEVELMCGPEYL

SEQ ID NO: 10374 - protein, 474 aa, Bacillus anthracis str. A2012
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERRDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 10375 - protein, 294 aa, Magnetospirillum magnetotacticum
MLGAVFHLARGAHVGFVLAREGGLALIDPAPLPPHLRLALKLGRSLERRGIAEAPGASPLERAMTRLGPSYVKFGQFLATRPDIVGMAAARDLERLQDRVPPFPQEIALKVVEQELGKPVPALFSSFSAPIAAASIAQVHKATVLDADGTQRSVAVKVMRPGVRERFAKDLQAMRFMARIVHALLPDAERLRPREVVEILARSVTMEMDFRLEAAAMSELAQNTAGDEDFRTPKPEWGLTARDVLTSEWIDGVRLNDRAGIVAAGHDPKALGRVVIQSFLRHGDPRRLLPRGIL

SEQ ID NO: 10376 - protein, 500 aa, Atriplex triangularis
MAFPMPVRQLFIDGERREPLLKNRIPIINPSTEEIIGDIPAATAEDVEVAVVAARKAFKRNKGRDWAATSGAHRAKHLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 10377 - protein, 341 aa, Sporothrix schenckii
MDNYQKLEKVGEGTYGVVYKARDLTAGGRIVALKKIRLEAEDEGVPSTAIREISLLKEMRDPNIVRLYNIVHAEGHKLYLVFEFLDLDLKKYMDSLPVSDGGRGKALPEGTGTRLHTLGLGDDIIKKFMSQLCAGIRYCHSHRILHRDLKPQNLLINKEGNLKLADFGLARAFGVPLRTYTHEVVTLWYRAPEILLGGHQYSTGVDMWSVGCIFAEMAMRKPLFPGDSEIDEIFKIFRLLGTPTEDVWPGVTTYPDFKASFPRWVQDTETPICPTLDPMGQELLELMLVYDPASRLSAKQACNHPYFDDLEKALPGTAAAAARQHTTTAAAGGAYNGSGYH

SEQ ID NO: 10378 - protein, 344 aa, Clostridium tetani E88
MIIFLFCYRIVFRIFYNKEVFMINTKVLATITAISYSVIFGLSFLFTKKALIFATPFQLIAFRFLLAFIFMSILIFSKILKINYENKDIKGLFFLVLMQPIGYFIFETYGLKLSTSSQAGILTALIPIISSIVAVYILKEIPSKKQWFFIILSVIGVIFIVIMDKNSDSGNSLLGTFLLLGAIICGSFYHVLSRKVSSTFTPIETTYFMMGVGAVTFNFISIITHIKDNDFSNYFHLLYNKDFLIPLLFLGILSSVIAFLFVNFSLCYLEASKCAVFSNLSTVISILAGVLFLDEKIYWYHIIGSITILIGVYFTNYLNSNNKNTSSEKDVDLDESNKERAISK

SEQ ID NO: 10379 - protein, 928 aa, Oryza sativa
RSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKQIITKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKICHVLYPGDESPEGKVLRLKQQYTLCSASLQDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 10380 - protein, 919 aa, Emericella nidulans
MAAAQSGSENTELSKQPSPQNDGCQDDDNHDQIGSSTPSPSGIATPQPNPADRRLPSIMHNYFQVGSSSAVMLRSLKTRFSLSDPSPSSADTMQSGSLANGTRDAQSSGHTSSSSGSFVIMERDEARLESPTTPPDNEAETQEISQESRPPAALPTPPCSSACSLLQKESEEPEAGPDKGMGSIFNTLKNYLSPSRSVSCSDSQARRHTSHPVSSISDDPVLASHFFNPSLSQTPESLCLVEAPLLDHEKPHVSASSENAAKLTANVSNPSHLKNTPPHTPRAMSDEDLQSNGKAPASPPRSSNPTHSPRDEPSDSADEITGKLNEVFPSSMDTSSSPSSGPPVASLKGKLHVKISEGKGLQPGFDPYVVCVFEWNEVISKSVQDEEQESLKRQQKELEQSALDSGRPMAIPMNRQSSHNNTLESTDHRGHAPITDPHWNHEAVFDVFGDQSEIDVSVYDRNDSEAFLGHVRLCVNLKEDNSRLDGWFPLKGRAAGDSRVSGEIHMEMRFEKTEKKQVGPNDFQILKLIGKGTFGQVYQVKKKDTRRIYAMKVLSKKVIIQKKEVAHTVGERNILVRTAMAASPFIVGLKFSFQTPTDLYLVTDYMSGGELFWHLQKEGRFQEPRAKFYIAELIMALQHLHDHDIVYRDLKPENILLDANGHIALCDFGLSKANLTQNDTTNTFCGTTEYLAPEVLLDEQGYTKMVDFWSLGVLVFEMCCGWSPFYAEDTQQMYKNIAFGKVRFPRDALSTEGRNFVKGLLNRNPKHRLGAQNDAKELMAHPFFHDIDWEALGRKEVIPPFKPKLKSDTDTSNFDPEFTNALENSNSLNDRAAALANGFMAASTPLSPGMQANFQGFTFVNESSIDHHFKNEVGDRMDEDYEPMHRSHRSGNSIDHRMAGVQKTGDAGEIFNVDDNFDM

SEQ ID NO: 10381 - protein, 130 aa, Ralstonia eutropha
KCIGCHTCSVTCKNVWTSRDGVEYAWFNNVETKPGIGYPKEWENQDKWQGGWKRNADGTLEPRQGGKLKILANLFANPNLPQIDEYYEPFTYDYEHLQKAPLVQTPPTARPVSVLTGRKMEKIEWGPNWE

SEQ ID NO: 10382 - protein, 335 aa, Chlamydia muridarum
MRIVINGFGRIGRLVLRQILKRNAPIEVVAINDLVSGDLLTYLFKYDSTHGSFASQATFSDGCLVVGERKIRFLAEKDVQKLPWKDLDVDVVVESTGLFVNKDDAAKHLDSGAKRVLITAPAKGDVPTFVMGVNHQKFDPANDVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAVCEAVKHAASTSMRNIMHYTEEAVVSSDFIGCEYSSVFDAQAGVALNDRFFKLIAWYDNEIGYATRIVDLLEYIQGNSK

SEQ ID NO: 10383 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 10384 - protein, 305 aa, Yarrowia lipolytica
MSDKSNFLVDFLMGGVSAAVSKTAAAPIERVKLLIQNQEEMIKQGRLSRPYKGIIDCFKRTAADEGIASFWRGNTANVIRYFPTQALNFAFKDKFKKMFGFKKSEGYWWWMAGNLASGGLAGATSLAFVYSLDYARTRLANDAKSVAKDGKAAGERQYNGLIDVYRKTIASDGIAGLYRGFGVSVVGIIVYRGLYFGLYDSLKPVVLVGPLEGNFLASFLLGWTVTTGASTASYPLDTVRRRMMMTSGTGVKYSSSMACMASIIKNEGVGALFKGCGANILRGVAGALVISMYDQMQMIMFGKKF

SEQ ID NO: 10385 - protein, 157 aa, Pisum sativum
MDFRLMDLDSPLFNTLHHIMDLTDDTTEKNLNAPTRTYVRDAKAMAATPADVKEHPNSYVFMVDMPGVKSGDIKVQVEDENVLLISGERKREEEKEGVKYLKMERRIGKLMRKFVLPENANIEAISAISQDGVLTVTVNKLPPPEPKKPKTIQVKVA

SEQ ID NO: 10386 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQLFVVRIPENLPLEQAAPLLCAGVTVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 10387 - protein, 834 aa, Oryza sativa (japonica cultivar-group)
MHPVASDSHDQEAEEARTRLMLIMHAEAISLMLSAAKLHPARLANSFYNMWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNRQNIDGGWGLHAEGESSMLSTALNYTALRLLGENVDDGPDISMHKARKWIHDHGGATMIPILGKVWLSVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQKALSMLCCWIENPNSDAFKRHLARVADFLWVGEDGMKVRVCAGQLWDVAFAVQAILACSIAEEFGSTLKKAHGFIKTSQIMDNPSGDFSRKYRHISKGGWAFQVADQGWQVSDCTAEALKALLLLSKCLSDGADYQMETYCYFDAVNVLLSLQNPNGGYGAWELARTYPWMESQGILQSIRTIKGEGEYVECTSSVIQALALFREKYPGHRKDEIDQCIRKATEFIEKLQNDDGSWFGSWGICFTYGTWFAIEGLSAVGQCYDDSTCIRKACKFLLSKQLTNGGWGESHLSSRTKAYTNLDGEKSHIVNTAWAMLALMKAGQVERDPAPLHKAARLIMSMQLSDGDFPQEEMIGSFLKNGPLCYMAYRNIFPIWALGEYQKLVFQNYQTSSIKQTNIAPSAGNAALKNSASTTAPT

SEQ ID NO: 10388 - protein, 151 aa, Zea mays
MASDGVVALYGNNKAVVEPSAKPAAATFSVKVGLAQMLRGGVIMDVVTAEQARLAEEAGACAVMALERVPADIRAQGGVARMSDPALIRDIKRAVTIPVMAKARIGHFVEAQILEAIGVDYVDESEVLTLADDAHHINKHNFRVPFVSGCR

SEQ ID NO: 10389 - protein, 546 aa, Glycine max
  unsure (1)..(546): unsure at all Xaa locations
GNSARGSVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDSSIAVHFLGNFLYLFIASTMLGVLTGLLSAYIIKKLYIGRHSTDREVALMMLMAYLSYMLAELCYLSGILTVFFCGIVMSHYTWHNVTESSRITTKHSFATLSFVAEIFIFLYVGMDALXACSIVLFDLFLFGRAAFVFPLSFLXLLGRAAFVFPLSFISNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 10390 - protein, 308 aa, Escherichia coli O157:H7 EDL933
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINAGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 10391 - protein, 299 aa, Zea mays
MNFCRHLLLAAVFALLLAVCASAASRGAGSFDPSRVVQLSWRPRAFLHKGFLSDAECDHLIALAKDKLEKSMVADNESGKSVQSEVRTSSGMFLERKQDEVVTRIEERISAWTFLPPENGESIQILHYQNGEKYEPHYDYFHDKKNQALGGHRIATVLMYLSNVEKGGETIFPNAEGKLLQPKDNTWSDCARNGYAVKPVKGDALLFFSLHPDATTDSDSTRGSCPVIEGQKWSATKWIHVRSFDLPVKQPGSSDGCEDDNILCPQWAAVGECAKNPNYMVGTKEAPGFCRKSCKVCAE

SEQ ID NO: 10392 - protein, 237 aa, Sinorhizobium meliloti
MRSEMEEFHKVRRLPPYVFEQVNRLKASARAAGADIIDLGMGNPDLRTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEF

SEQ ID NO: 10393 - protein, 277 aa, Glycine max
  unsure (1)..(277): unsure at all Xaa locations
HYFSFHWCSLNYGINILQGIQNENKNLKKSLKDVVTENEFEKKLLADVIPPTDIGVTFDDIGALENVKDTLKELVMLPLQRPELFCKGQLAKPCKGILLFGPPGTGKTMLAKAVATEAGANVINISMSSITSKWXFGEGEKYVKAVCSLASKIAPSVFFVDEVDSMLGRRENPGEHEAMRKMKNEFMVNWDGLRTKDKERILVLAATNRPFDLDEAVIRRLPRRLMVNLPDAPNRGKIVRVILAKEDLAPDVDFEAIXQILNGINFFPGEKRWKPPF

SEQ ID NO: 10394 - protein, 404 aa, Neisseria meningitidis Z2491
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLDDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 10395 - protein, 369 aa, Oryza sativa
MWRLKVAQGGGALLRSTNGFAGRAVWEFDPDHGTPEDRANVERVRRDFTDHRLRRPESADLLMRMQVCVVCSSGLIIIVALEKDTEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSIIGVYEWSGNNPIFPELWLAPQFLPFHPGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKV

SEQ ID NO: 10396 - protein, 307 aa, Campylobacter jejuni
MHNILFGNILNRSVTMKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNHVATGLYFYNNDAIDIAKNVKPSARGELEITDVNIEYLRLNKLKSQHLGRGFAWIDTGTHDSLIEASSFVQTIELRQGYKIACLEEIAYNNNWIDNEILEKRALLLSKSNYGQYLYKILSQGK

SEQ ID NO: 10397 - protein, 123 aa, Oryza sativa
MARIPLLLALLLAVSAAAAAQVGGNRGHGPLVGGWSPITDVGDPHIQELGGWAVERHASLSSDGLRFRRVTSGEQQVVSGMNYRLVVSASDPAGATASYVAVVYEQSWTNTRQLTSFKPAAAH

SEQ ID NO: 10398 - protein, 361 aa, ASPERGILLUS NIDULANS FGSC A4
MAQQDYKFEGWMGLDKNAADGNMVWQEFEPKEWEETDVDIKITHCGICGSDLHTLRSGWRPALYPCCVGHEIVGTAVRVGSKAVGGIKLGDRVGVGAQSDACVGRFGDCPECAMGWENYCSHKFVSTYNSVHFNGGKSYGGYALYNRCPSHFVVKIPDAVPSAEAAPMLCGGVTLYSPLKHNNCGPGKRVGIIGVGGLGHFGVLFAKALGADKVVAISRKNGKSEDALKMGADQYIATDDEPDWATKYARSLDLIVCTVSSTKMPLAEYVGLLATNGSFVQVGLPEDGVLNAPVANLRRRLKMESSLVGSPNEIREMFALVAEKGIKPWIETVPMKDANKAIVDMHEGKARYRYVLVNEEH

SEQ ID NO: 10399 - protein, 841 aa, Oryza sativa; identical to SEQ ID NO: 7321

SEQ ID NO: 10400 - protein, 576 aa, Oryza sativa
SWLITGRGVAKKIRNAPHCSSRPISELGAEAQMECPNCKHVIDNSDVAIQWPGLPAGVKFDPSDLELLEHLEQKIGLGGSKPHTFIDEFIPTIDNDEGICYSHPENLPGMKKDGTSGHFFHRVSNAYGCGQRKRRKISNCDHVVSVEHTGKSKAIVEKGVTKGWKKIMVLYKSSHIGAKPDKANWVMHQYHLGAEEDEKDGELVVSKISYQLHGKQIDKSETGNADEESDAFAARVGPKTPKSNTPQPCRLKNSPCETENYDPILEDQDEEESNIPIVSLKDDAGNPAWCAGETQAAREAVQACPNLDESLRCHEVLDSFYHETLLPSDRPILSQGGNEILDRNLNAVYGLPDLYNVDLGTPPDFQLAVHGDEEPLCFPYKEMRMPPCYFDGPAWQNAVPQIRTKCPLAQDLVRHLLDFAPPKLNETVALFLAALDRRTSLTLVQEMKLCERHIYCVGDSVHGWARGPRAADGGCLATRVAEEGARLVYGHRQAGKNRDRHIAGRPAGRPARRRLLRDTDREMARRPRTLYPEPSFASTHSGFGFSHVSRTRLQKLNLQVDRWIDQDVFSVHELLA

SEQ ID NO: 10401 - protein, 517 aa, Zea mays
  unsure (1)..(517): unsure at all Xaa locations
MFIESFRVESPHVRYVPRWRSSRSTGTTATELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVXLDIDLQKQLRPYMXESMVPLPGIYDPDFIAANQGLSXANSVIKGTKKEQVEQIIKDIREFKEKNKVDKIVVLWTANTERYSNVCAGLNDTMENLLASVDKNEAEVSPSTLYAIACVMEGXPFINGXSPQNTFVPGXLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKGTPXVPPGTPVVNALAKQRAMLENIMRACVGLAPENNMILEYK

SEQ ID NO: 10402 - protein, 394 aa, Arabidopsis thaliana
MGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 10403 - protein, 170 aa, Vibrio vulnificus CMCP6
MGHAESKFQPANIAVLTVSDTRTEENDTSGAYLVENAKEAGHNVVDKQIVIDDMYKIRAIVSQWIADENVQAIMITGGTGFTSRDSTPEALKPLFDKEVEGFGELFRLVSYEEIGTSTIQSRAIAGFANHTVIFAMPGSTGACRTGWTKIIKQQLDASHRPCNFMPHLSV

SEQ ID NO: 10404 - protein, 319 aa, Mesembryanthemum crystallinum
MGYLDSVLSSSNQVHVEEQPVSGGGISQNGKFSYGYASSPGKRSSMEDFYETRIDGVEGEVVGLFGVFDGHGGARAAEYVKQNLFSNLIKHPKFISDTKSAIAEAYTHTDSEFLKSENTQNRDAGSTASTAILVGDRLLVANVGDSRAVICRGGEAIAVSRDHKPDQSDERQRIEDAGGFVMWAGTWRVGGVLAVSRAFGDKLLKQYVVADPEIQEEVVDSSLEFLILASDGLWDVVTNEEAVTMVKPIQDTEEAAKKLMQEAYQRGSADNITCVVVRFLDNPIDSSSNRISGNHGDTSSRVLGGSHTDSSNRFLGKPR

SEQ ID NO: 10405 - protein, 607 aa, Oryza sativa
  unsure (1)..(607): unsure at all Xaa locations
METHIGSVDGAAAAADNGAVGCPASAVGCPMTSARPAPVSXRRGVAGTAPGEAAGAGGRQRRVRXVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCXTQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 10406 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVLGVSFTEQEVADLTKRIQNAGTEVVEAKAGGGSATLSMGQAAARFGLSLVRALQGEQGVVECAYVEGDGQYARFFSQPLLLGKSGVEERKSIGTLSAFEQNAL

SEQ ID NO: 10407 - protein, 318 aa, Carica papaya
MENFPVIDLSKLNGEERALTMELIHDACENWGFFELVNHGISHDLMDTVERLTKEHYMKCMEQRFKEMVESNGLEAVQSEINDMDWESTFFLRHLPASNMHEIPDLEDDYRKAMKEFAVGLQKLAEQMLDLLCENLGLQKGYLKKVFYGSKGPNFGTKVSNYPPCPKPDLIEGLRAHTDAGGIILLFQDGKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 10408 - protein, 181 aa, Triticum aestivum
MLAVLELAVAVLPVLELTAVVAVPAAVASVAARHGYPSGGHGYPPQQHGYPQQGYPPQHGYPPQQHGYPPQQHGYPPAGYPGSSGHSGSHGGGGMGMGGMLAGGAAAAAAAYGAHKLSHGGHGGGGHMMGGMMGGHGGYGGGYGHHGGKFKHGKHGHGKFKHGKHGKHGMFGGGGKFKKWK

SEQ ID NO: 10409 - protein, 337 aa, Synechocystis sp. WH 8501
MIRVAINGFGRIGRNFLRCWLGRENTGLEVVGINDTSDPRTNAHLLRYDSMLGILDADIEADENSITVNGKTIKCVSDRNPLNLPWTEWNVDLVIESTGVFVTEEGASKHIVAGAKKVLITAPGKGGNVGTYVVGVNAQDYEHDKHNVISNASCTTNCLAPVVKVLNDNFGIIKGTMTTTHSYTGDQRILDASHRDLRRARAAAVNIVPTSTGAAKAVALVIPEMKGKLNGIAMRVPTPNVSVVDLVAQVEKSTIAEQVNDIFKTASEGSMKGVLGYNDLPLVSCDYRGTDVSSIVDASLTMVMGGDMVKIVAWYDNEWGYSQRVVDLAEVVANKWK

SEQ ID NO: 10410 - protein, 245 aa, Lilium longiflorum
MGRGKIEIKRIENTTNRQVTFCKRRNGLLKKAYELSVLCDAEVALIVFSTRGRLYEYANNSVKGTIERYKKASSDAFNTGSVSEANAQYYQQESSKLRNQIVSLQNAHRSMLGESIGSMGTQGTEIHGEKAGKMDNNKIRTKKNELLFAEIEYMQKREAELQNNSMFLRTKIAENERSQQQQMDMERSQQQHMDMDRSHQRHLEMLPTTSAFETMPTFDSRNFFDINLIEAHHHYQQQQTALQLG

SEQ ID NO: 10411 - protein, 213 aa, Oryza sativa (japonica cultivar-group)
MGEEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 10412 - protein, 435 aa, Spyridia filamentosa
  unsure (1)..(435): unsure at all Xaa locations
ETDVLALFRVTPQPGVDPVEASAAVAGESSTATWTVVWTDLLTACDLYRAKAYRVDQVPNSTEQYFAYIAYDIDLFEEGSIANLTASIIGNVFGFKAVKALRLEDMRIPYAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTMEDMYERSEFAKELGSVIIMIDLVIGYTAIQTMGIWARKNDMILHLHRAGNSTYSRQKNHGMNFRVICKWMRMAGVDHIHAGTVVGKLEGDPKMIQGFYRTLLEPFLEVDLPQGLFFEQDWASLRKVTPVASGGIHCGQMHQXIQYLGNDVVLQFGGGXIGXXXXXXXXXXXXXVALESMIIARNEGRDYINEGPQILRDAAKTCGPLQTALDLWKDITFN

SEQ ID NO: 10413 - protein, 330 aa, Triticum aestivum; identical to SEQ ID NO: 3218

SEQ ID NO: 10414 - protein, 84 aa, Glycine max
MKVNILQWHAVASWTWDAQDETCGICRMAFDGCCPDCKLPGDDCPLIWGVCNHAFHLHCILKWVNSQTSQAHCPMCRREWQFKG

SEQ ID NO: 10415 - protein, 684 aa, Oryza sativa
MDEEAKPNPNADAAPAAAEAAASSPPPLSSSESAEGKDKEEEKEEEEEEEAGDLVEKLVELVEEIAAISDFRNAYRRQFCNLSRRIRLLAPMLEEAKEGPRPLPDVSYSALRRLREALADSRELLRLGVSGSKISLVLEREKIMKSFQDITARLEQALGLISFDELDISDEVREQVELVHAQFKRAKERSDPSDDDLFNDLVSVYNSSTSANVDPDILQRLSDKLQLATISDLNQESLILHEMASGGDPGAVVEKMSMLLKRIKDFVQSRDPEMGTPVNTTELSGKDNMASLIVPDDFRCPISLDLMKDPVIVATGQAGHDTCPKTQQKLPNKSLTPNYVLRSLIAQWCEANGMEPPKRAAQHHNAPASCTAAEHSNVVELLQKLLSQNLEDQREAAGMLRQLAKRSPENRACIGDAGAIPILVSLLSITDVSTQEHVVTALLNLSIYEENKARIITSGAVPGVVHVLKRGSMEARENSAATLFSLSLVDENKITIGASGAIPALVLLLSNGSQRGKRDAATALFNLCIYQGNKGKAVRAGLIPVLLGLVTETESGMMDEALAILAILSSHPEGKTAISSANAIPMLVGVIRNGSARNKENAAAVLVHLCNGEQQQQHLAEAQEQGIVTLKVKPKPKQRPWHKLMRMHSLKLRFRLLTKLNLSGLFFWLRLAVGRSPAMPSVEV

SEQ ID NO: 10416 - protein, 95 aa, Glycine max
  unsure (1)..(95): unsure at all Xaa locations
MFIHNFKVKCPKVKYTDTXIQSVYNYXTTETCSRVTRMAPYQWISQIKSVRYEFKTNIHVPKLRVMHVGWGGNNGSVLTSSVSANREGISWATKD

SEQ ID NO: 10417 - protein, 360 aa, Triticum aestivum
MGSVDASETTVTGWAARDATGHLSPYTYTLRKTGPEDVVLKVKYCGICHTDIHQVKNDLGASKYPMVPGHEVVGEVVEVGPEVSKFRAGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDADQMAAAADSLDYIIDTVPAKHPLEPYLALLKMDGKLVLMGVIAEPLSFVSPMVMLGRKTITGSFIGSMDETEEVLQFCVDKGLTSQIEVVKMDYVNQAFERLERNDVRYRFVVDVGGSNIEDAA

SEQ ID NO: 10418 - protein, 519 aa, Lycopersicon esculentum
MPADPDNSSAMNDSTGSGEASVSSSGNQVVPLKESAKKKRNLPGMPDPDAEVIALSPTTLLATNRFVCEICSKGFQRDQNLQLHRRGHNLPWKLRQRSSNEVKKRVYVCPESSCVHHDPSRALGDLTGIKKHFCRKHGEKKWKCDKCSKKYAVQSDLKAHSKICGTREYKCDCGTLFSRAFCDALAQESAKTLPEKPPSTNEEPKTQAVASSSPPPSPPAPPPATESQPPPPPPAAPKSLMTPTVPPSTAVMSFASSVQNRELRENPVTNSAGAATKQVVEEAAVVASLTGNCSSSCSNGSSSSNVFGSLFASSTASGSLPSQAPVFSDIFRAMAPEHTLEMAPPSSTEPISLGLAMSHSSSIFRPAGQERRQYAPAPQPAMSATALLQKAAQMGAAATSSSFLRGIGVMSSTSSSNGHQEWSGRPSDANGASLAAGLGLGLPCDAGSGLKELMLGTPSVFGPKHPTLDLLGLGMAASVGPSPGLSALLTSMGSNLDMVTSAGSFGSADFSGKDLGRNS

SEQ ID NO: 10419 - protein, 298 aa, Saccharomyces cerevisiae
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQISSDLGDLMGGISIQSINEAGGKNGARLSEIGW

SEQ ID NO: 10420 - protein, 419 aa, Zea mays
PTRPVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 10421 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 10422 - protein, 354 aa, Clostridium perfringens str. 13
MNLGHGGNVEEIKRIYGLKENEIIDFSANINPLGISERVKEAMVRGINSIERYPDITYYELKKGISNFEKVALENIVIGNGAAEVIFNIVRGIKPKKALIVAPTFSEYEDALNSVECEVNHYILKDNYSVDNGFLEEIKEELDIIFLCNPNNPTGALIEKDFSLKVLEKAKKMNITVVFDESFLDFVEDNDRYSLIKELNNFQNLIIVKSLTKLFAFPGIRLGYGLSSNNNFIEKINSVVTPWSVNTVADYAGREALKDVEYIKNSVAYIKKENEFLYNGLENFKDITTFKGAVNFVFFKLNKNINLREELIRRGIIIRSCSNYIGLDNSFYRVAVRTREENKKLLEELSKVLK

SEQ ID NO: 10423 - protein, 174 aa, Glycine max
  unsure (1)..(174): unsure at all Xaa locations
MSMSMSMSTLPSSTFANSNLSLSTSLSSQKLPLFHTLHAKSLPLPFPHLRIQTPPPYLPPPLCKSPEGAEAEAAPPEEEEWLQKLPEKSEPLYSHXLPCSGAWLRSLGFCGRVGDRALWVVHKPDWHAELFLDLTDLYIRYLKSGPGNLEKNMERRFSYALSREDIENAVLGGP

SEQ ID NO: 10424 - protein, 951 aa, Oryza sativa (japonica cultivar-group)
MATASAPLQLATASRPLPVGVGCGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 10425 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKCNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNADPAKAIGPMYNQVVYQYPNWYYDVSVPAGKTIEFKFLKKQGSTVTWEGGSNHTFTAPSSGTATINVNWQP

SEQ ID NO: 10426 - protein, 483 aa, Xylella fastidiosa 9a5c
MLKKHLFIVKPIEPTNHTGTGKGETQLKRSLTAGQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNAAPGKYGMEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLLVGACACTLAGLFPISLLGDLVSMGTLLAFATVCIGIVVLRRTRPDLPRPFRVPMYWVIAPAGAAACLYLFWQPFTEHWPLMVGWTVLGLVMYGLYGYHHSKLRRGG

SEQ ID NO: 10427 - protein, 343 aa, SYNECHOCOCCUS SP. WH 8102
MSRRLLLLATGGTIAGQASDPTRLNDYTAGAMAGDALLAAVPQLQNLATISVEQVANVDSAELLFEHWRALVARIRAVFAADAELTGVVITHGTNTLEETAWLLQLLIDDPRPVVLVGAMRPATALSADGPLNLFQAVQVALSPEARGHGVLVVMDGQIHPSRHVGKVATQGVGAFASPGYGPLGCVDDMGVHLPTATGSRQVPFAALALPEQWPQVPIVYGCVEPDPLILQACLNAGAPGLVFTGTGAGQLSAGERSVLQAWAGSRPLMLRANRCGSGPVHHHHEDERLGLLPAGNLSPQKARVLLLLALIAGLSRDDLAELISAAPVTATPIIATPIIATP

SEQ ID NO: 10428 - protein, 490 aa, ASPERGILLUS NIDULANS FGSC A4
MVGVGPKRPPSRKGSMSDVPQNLLEHIKHFEEIFTVDTATLKKIVDHFVNELTKGLSVEGGNIPMNVTWVLGFPDGKETGTFLALDMGGTNLRVCEITLTEEKGGFDIIQSKYRMPEELKTGEAEELWQYIVDCVEQFIQFHHENENLSKLPLGFTFSYPATQDYIDHGVLQRWTKGFDIDGVEGKDVVPPLEKVFKERGLPIKVAALINDTTGTLIASSYTDPAMKIGCIFGTGVNAAYMENAGSIPKLAHMNLPPDMPVAINCEYGAFDNEHIVLPLTKYDHIIDRDSPRPGQQAFEKMTAGLYLGEIFRLALVDILDTQPGLIFKDQDTSQLRIPYLLDSSFPAAIEEDPYENLIETAELVQNMLKIKATRSELELMRRLAELIGTRAARLSACGVAAICKKKNIESCHVGADGSVFTKYPHFKARGAQALREILDWAPSEKDKVTIHAAEDGSGVGAALIAALTLKRVKAGNTAGIRDAQAMLAMC

SEQ ID NO: 10429 - protein, 419 aa, Oryza sativa
MENMRSENFNQGVSMEGVKHAPEMANTNRRALRDIKNIIGAPHQHMAVSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 10430 - protein, 299 aa, Oryza sativa; identical to SEQ ID NO: 9766

SEQ ID NO: 10431 - protein, 413 aa, Solanum tuberosum
MATAMVLDPKPAEKLPATRPETSITDVPSDGEDDLYARLKSLQRQLEFIEIQEEYVKDELKNLRREHLRAQEEVKRIQSVPLVIGQFMEMIDQNNAIVGSTTGSNYYVRILSTINRELLKPSASVGLDRHSNALVDVLPPEADSSISLLSQSEKPDVTYNDIGGCDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLGDEVDLEDYVSRPDKISAAEITAICQEAGMHAVRKNRYVILPKDFEKGYRTNVKKPDTDFEFYK

SEQ ID NO: 10432 - protein, 369 aa, Triticum aestivum
MAMLVDPPNGMGNQGKHYYSMWQTLFEIDTKYVPIKPIGRGAYGIVCSSINRETNEKVAIKKIHNVFDNRVDALRTLRELKLLRHLRHENVISLKDIMMPVQRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKTLPYTPGVPLASMYPHAHPLAIDLLQKMLIFDPTKRISVTQALEHPYMSPLYDPSANPPAQVPIDLDIDENISSEMIREMMWQEMLHYHPEAATAVNM

SEQ ID NO: 10433 - protein, 394 aa, Hordeum vulgare subsp. vulgare
VRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 10434 - protein, 506 aa, Pseudomonas syringae pv. tomato str. DC3000
MRYAHPGTEGAIVNFKERYGNYIGGEFVAPVKGQYFTNTSPVNGKPIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPILMAAWKLAPALAAGNCIVLKPAEQTPLGISVLIELIGDLLPAGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLEIAKGEGAELLTGGKVEKLEGDLSTGYYIQPTLLKGNNKMRVFQEEIFGPVVSVTTFKDEAQAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 10435 - protein, 92 aa, Triticum aestivum
MAGKARVFMCVALVVLLLLVETTAPTGQAHAVDCGGACSYRCSKSSRPNLCNRACNTCCRRCNCVPPGTAGNEDVCPCYAHMTTHDGRHKCP

SEQ ID NO: 10436 - protein, 150 aa, Triticum aestivum
MAEQQQKGGDDEVLEVECALDMPEVVQRQDSLYRDASRAGGASHHGHERWGKTLRLAFQCVGVLYGDIGTSPLYVYSSTFTAGVRHTDDLLGVLSLIIYSFILFTMVKYVYIALRANDDGDGGTFALYSLISRHAKVSLVPNQQAEDELH

SEQ ID NO: 10437 - protein, 146 aa, Glycine max
  unsure (1)..(146): unsure at all Xaa locations
APPPKSFVSEYPIVSIEDPFDQDDWVHYAKMTVEIGEQVQIVGDDLLVTNPTRVAKAIKEKSCNALLLKVNQIGSVTESIEAVKMSKRAGWGVMTSHRSGETEDTFIADLAVGLSTGQIKTGATCRSERLXKYNQLLRIEEELGAI

SEQ ID NO: 10438 - protein, 1027 aa, Oryza sativa
  unsure (1)..(1027): unsure at all Xaa locations
MRVTVTPKDEERLVVLMARERPRSAVVAPGGDLVTAGGGGGGGGGGEGSDGDSSGSLEEISADDFKKESSAAGGAAAAAAAQQRSRVWMGYNIPRSYAPAFHSFAWAQAVQNKPLVPRAADAADEDEVEHVVDTSDEEKEEGEIEEGEAVQTTTTSSSSPPCAQPPETIDLDSDAPEKSESMVAMYGGGAAPAGAEEEEVDFDQRVGSILEELEMVSIEEAEKYGLMILLYGKVHVLDVFWCMIQLLRDPILMFCRSFEGACTRLRTCFENLKPLFPESGSPMPMLDALVQQAFVGIDTITTLDSRVRQLVFEDGKDNANGPNATSTNAAAPSGQVLSERLPFESGAGNSFSKVEIPAKNRMVSPLLDLHADYDENSLPSPTRDSKPPFDVPKPIGYGALPMAPDRPSVLERVEPAKNSSYQSFNDALKAVCYYQQKHGQKSNFASDDLPSPTPSGDGDKSGDKGGDVFGEVSSFSASNKIALPIVNQMPSRPSTVSSNSDSFAGGPPGYAKQIENSVSGSNHLLKATAKSRDPRLKFLNRDTGGVADANRRVNFAEPNPSKDRTMGGGVSINSRKNKAVDEPMVDENALKRSRGVIGNLRDMQPTGRDIAVNPTMLMQWIQMEQQKMSASEPQQKVTASVGMTSNVTPGMVLPLGNAPKTTEVAAVPSVRPQVPMQSAPMHSQNDTGVIRMKPRDPRRILHSNIVQKNDTVPPVGVEQAKSNGTAPPDSQSSKDHLLNQDQKAEQLQAIALPSLPVTSSARPVTMNANPVSNSQLAATALMPPHGNTKQTSSSVNKADPRLAAGQNESNDDAATSTGPVTAPDAVPPASPYGDVDHLLDGYDDQQKALIQKERARRIKEQHKMFAARKLCLVLDLDHTLLNSAKFIEVDHIHGEILRKKEEQDRERAERHLFCFNHMGMWTKLRPGIWNFLEKASKLYELHLYTMGNKVYATEMAKVLDPTGTLFAGRVISRGDDGDPFDSDERVPKXYTYFPCSRRQFGLPGPSLLEIDRDERPEDGTLASSLAV

SEQ ID NO: 10439 - protein, 497 aa, Taxus chinensis
MDSFIFLRSIGTKFGQLESSPAIISLTLAPILAIILLLLFRYNHRSSVKLPPGKLGFPLIGETIQLLRTLRSETPQKFFDDRLKKFGPVYMTSLIGHSTVVLCGPAGNKLALSNEDKLVEMEGPKSFMKLIGEDSIVAKRGEDHRILRTALARFLGAQALQNYLGRMSSEIGHHFNKKWKGKDEVKVLPLVRGLIFSIASTLFFDANDGHQQKQLHHLLETILVGSLSVPLDFPGTRYRKGLQARLKLDEILSSLIKRRRSDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEKFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 10440 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 10441 - protein, 677 aa, Saccharomyces cerevisiae
MHHHHHHSSGLVPRGSGMKETAAAKFERQHMDSPDLGTDDDDKAMGSAPSFNVDPLEQPAEPSKLAKKLRAEPDMDTSFVGLTGGQIFNEMMSRQNVDTVFGYPGGAILPVYDAIHNSDKFNFVLPKHEQGAGHMAEGYARASGKPGVVLVTSGPGATNVVTPMADAFADGIPMVVFTGQVPTSAIGTDAFQEADVVGISRSCTKWNVMVKSVEELPLRINEAFEIATSGRPGPVLVDLPKDVTAAILRNPIPTKTTLPSNALNQLTSRAQDEFVMQSINKAADLINLAKKPVLYVGAGILNHADGPRLLKELSDRAQIPVTTTLQGLGSFDQEDPKSLDMLGMHGCATANLAVQNADLIIAVGARFDDRVTGNISKFAPEARRAAAEGRGGIIHFEVSPKNINKVVQTQIAVEGDATTNLGKMMSKIFPVKERSEWFAQINKWKKEYPYAYMEETPGSKIKPQTVIKKLSKVANDTGRHVIVTTGVGQHQMWAAQHWTWRNPHTFITSGGLGTMGYGLPAAIGAQVAKPESLVIDIDGDASFNMTLTELSSAVQAGTPVKILILNNEEQGMVTQWQSLFYEHRYSHTHQLNPDFIKLAEAMGLKGLRVKKQEELDAKLKEFVSTKGPVLLEVEVDKKVPVLPMVAGGSGLDEFINFDPEVERQQTELRHKRTGGKH

SEQ ID NO: 10442 - protein, 373 aa, Oryza sativa (japonica cultivar-group); identical to SEQ ID NO: 10149

SEQ ID NO: 10443 - protein, 331 aa, Neurospora crassa
MSSVKQSAQAATSDVVDTAKNATAETVTAATDFLHTPAVRAALPFINGGLSGMVATTVIQPIDMIKVRIQLAGEGKAGGPKPTPLGVTRDIIASGKAMDLYTGLSAGLLRQAVYTTARIGCFDTFMSRLSARAKEKGQSVGFKERASAGLAAGGLAAMIGNPADLALIRMQSDGLKPVAERKNYKSVIDALGGIARNEGVAALWAGAAPTVVRAMALNFGQLAFFSEAKAQLKARTQWSSKVQTLSASAIAGFFASFFSLPFDFVKTRLQKQTRGPDGKLPYNGMVDCFAKVAKQEGVFRFYRGFGTYYVRIAPHAMVTLLVADYLGWLTK

SEQ ID NO: 10444 - protein, 330 aa, Zea mays
MASRLVYPVCHNICPEKSYCSCTGVVRPSCDLPKKKKKKKKKKKKKPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 10445 - protein, 164 aa, Nostoc punctiforme
MDKRYFLQASAVIVGTALLSRYINWGAKAVTTSNSGFEITKPEEEWRTILTPEQFNVLRKHGTERPHTSALDKEYDKGTYYCAACELPLFTSDTKFNSGTGWPSFFNPIEGAIATTVDKSLFMTRVEVHCSRCGGHLGHVFDDGPAPTGKRYCMNGVSLKFTPA

SEQ ID NO: 10446 - protein, 135 aa, Glycine max
AAAGKTYTNCVTIRKAVKFLLSIQTEDGGWGESYLSGAKNTYVPLEGNRSNVVQTAWALMALIHAGQAEKDPTPIHNAAKLLINSQLEDGDWPQQEVTGLFLKTGALHYPLYRNYFPMWALSEYRKKVMLPCTAA

SEQ ID NO: 10447 - protein, 363 aa, Magnetospirillum magnetotacticum
MTAPAPRPGIMDIKAYVGGESAIEGVDRILKLSSNEGALGPSPKAMEALRAMAPEMHRYPDGGAEELRKAIAARFKLDAARIVCGAGSDELLGILCRAYAGPGDEVLYSAHGFLMYAIAAKACGATPVTAPEVDLTANVDNLLKAVTPRTKILFLANPNNPTGTYLPASEVARLRAGLRSDVLLVIDAAYTEFVSRNDYSGGLELVEAGDNVVVCRTFSKMYALGGLRLGWAYCPENVAGVLNRVRNPFNVGAPALAAGLAAFNDTAYADLCKSHNDYWLPWLSGQIAALGLTVIPSVCNFILVRFPAQPGKDAASADKFLRSKGIIVRAMGGYGLGDSLRITIGTGEENQLVVAALKEFLGA

SEQ ID NO: 10448 - protein, 426 aa, Batrachospermum pseudogelatinosum
IEASAAVAGESSTATWTVVWTDLLTACDLYRAKAYKVDAVPNTSDQYFAYIAYDIDLFEEGSIANLTASIIGNVFGFKALKALRLEDMRLPIAYLKTFQGPATGTIVERERMDKFGRPFLGATVKPKLGLSGKNYGRVVYEGLKGGLDFLKDDENINSQPFMRWRERYLFAIEGVNRAQASAGEIKGHYLNVTAGTMEDIYERAEFAKELGSIICMVDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADF

SEQ ID NO: 10449 - protein, 219 aa, Papaver nudicaule
EMSVLCDAEVALIVFSTKGKLFEYSTDSGMDRILERYERYSYAERELVTTEIDQGNWSLEYSKLKSKIEILQKNQRHFMGEDLQSLSLKELQNLEQQLDVALKQIRSRKNQLMYESISELQKKEKALQEQNNKLGKQLKEKEKEVAAQQQQASQWDQQVTQGQSSPSFLLSQSLPNLNIGNGSYQVRGGNNGNEEEIRTQTTRTNTATPMPHWMVNHLR

SEQ ID NO: 10450 - protein, 235 aa, Nostoc sp. PCC 7120
MTQNRSEKPIVISPSILSADFSRLGDEIRAVDAAGADWIHVDVMDGRFVPNITIGPLVVEAIRPVTKKPLDVHLMIVEPEKYVEDFAKAGADIISVHCEHNASPHLHRTLGQIKELGKQAGVVLNPGTPLELIEYVLELCDLILIMSVNPGFGGQSFIPGVVPKIRQLRQMCDERGLDPWIEVDGGLKANNTWQVLEAGANAIVAGSAVFNAKDYAEAITNIRNSKRPTPELAKV

SEQ ID NO: 10451 - protein, 203 aa, Clarkia concinna
RHELSMLCDAEVALIVFSTKGKLFEYSTDSSMEKILERYERYSYAERQLATNDSDPQGSCWTFECPKLMAKIEVLQRNIRHYVGEDLDPLSQRELQSLEQQIDTAIKRIRTRKNQLMHETISELHKKEKVLQEQNNLLSKKLKDNENALAERAQREQEFGQNTSNFMFPPATPPLLLHSLTIGGTFQGNVAPGKENEAQVRPS

SEQ ID NO: 10452 - protein, 511 aa, Mycobacterium tuberculosis H37Rv
MRSVTCSATLVLPVIEPTPADRRPRHLLLGSAGHVSGRLDTGRFVQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 10453 - protein, 472 aa, Medicago truncatula
QPYDQINWNKARNTIAKEDLYYPHPMIQDMLWGFLYHVGEPFLNCWPFTKLRQKALEIAINHVGYEDENSRYLCIGSVEKVLCLIARWVEDPNSEAYKLHLARIPDYFWLAEDGMKIQSFGCQMWDAAFAIQAILACNVSEEYGPTLWKAHDFLKASQVVENPSGEFKAMYRHICKGSWTFSMHDQGWQVSDCTAEGLKAALLLSKMPSDLVGEKLESERLYDAVNVILSLQSSNGGFPAWEPQNAYSWLEKFNPTEFFEDTLIEREYAECTGSAMQALYLFTKLHPTHRAKEIHHCLSKAINYIENTQNPDGSWYGCWGICYTYGTWFAVQGLTACGKNYHNSPSLRKACQFLLSKQLPDGGWGESYLSSQNKVYTNLEDNRANLVQTSWALLSLISAGQADIDPTPIHRGMKLIINSQMEDGDFPQQEITGVFMRNCTLNYSSYRNIFPIWALGEYRHQVLSAQTPNAAP

SEQ ID NO: 10454 - protein, 334 aa, Anabaena variabilis
MLAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLS

SEQ ID NO: 10455 - protein, 579 aa, Brassica napus
MNNNWLGFSLSPYEQNHHRKDVCSSTTTTAVDVAGEYCYDPTAASDESSAIQTSFPSPFGVVLDAFTRDNNSHSRDWDINGSACNNIHNDEQDGPKLENFLGRTTTIYNTNENVGDIDGSGCYGGGDGGGGSLGLSMIKTWLRNQPVDNVDNQENGNGAKGLSLSMNSSTSCDNNNYSSNNLVAQGKTIDDSVEATPKKTIESFGQRTSIYRGVTRHRWTGRYEAHLWDNSCKREGQTRKGRQVYLGGYDKEEKAARAYDLAALKYWGTTTTTNFPMSEYEKEIEEMKHMTRQEYVASLRRKSSGFSRGASIYRGVTRHHQHGRWQARIGRVAGNKDLYLGTFGTQEEAAEAYDIAAIKFRGLTAVTNFDMNRYNVKAILESPSLPIGSAAKRLKEANRPVPSMMMISNNVSESENNASGWQNAAVQHHQGVDLSLLQQHQERYNGYYYNGGNLSSESARACFKQEDDQHHFLSNTQSLMTNIDHQSSVSDDSVTVCGNVVGYGGYQGFAAPVNCDAYAASEFDYNARNHYYFAQQQQTQHSPGGDFPAAMTNNVGSNMYYHGEGGGEVAPTFTVWNDN

SEQ ID NO: 10456 - protein, 338 aa, Zea mays
  unsure (1)..(338): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIXSSTGAAKAVGKVLPVLNGKLTGMSFRVPTVDVSVVDLTVRLEKSATYDEIKAAVKAEAEGSLKGILGYVEEDLVSTDFQGDSRSSIFDAKXAGIALNGNFVKLVSWYDNEWGYSTRVVDLIRHMNSTK

SEQ ID NO: 10457 - protein, 173 aa, Triticum aestivum
  unsure (1)..(173): unsure at all Xaa locations
APHPTPREARHSTEEAERAGTAEDKKPAGDGGGAHXNXKGKGQXGXEGXXRXKRXTQGRKXXNAXXDRQXXXHNTKANXDEGRRHXXEQTXXEXEKEEGDENDAXQDQTGGSKPRPKKEQAGKQTERRRGPPGEPGGRGGRERTGEAAGGHNPRGRAGERTGGGRGGGGAGGG

SEQ ID NO: 10458 - protein, 472 aa, Magnetospirillum magnetotacticum
MTMSDDVKKVLELIKENDVKYVDFRFTDPRGKWQHTAQHVSTVDADMLNEGIMFDGSSIAGWKSINESDMILKPDASSAVMDPFAAQSQLIINCDIVEPATGQLYDRDPRSIAKRAEAYVKSSGVGDATYFGPEAEFFVFDDVKYELGMNKGYYELRSEDGVEAQGRDFAEGNLGHRPGVKGGYFPVPPVDGHVDMRAEMLTVMGEMGLPIEKHHHEVASSQHELGIKFGSLVQAADWIQIYKYVVHNVAASYGKTATFMPKPIYGDNGSGMHVHQSIWKAGKPLFAGSGYADLSDTALYYIGGIIKHAKAINAFTNPLTNSYKRLIPGFEAPVLLAYSARNRSASCRIPYSASPKGKRVEVRFPDPGANPYLAFSAMLMAGLDGIANKIHPGDPMDKNLYDLPPEELKLVPTVCGSLREALESLRANSDFLCKGDVFSKEFIESYIDLKYEEVYRFEHTPHPVEFQMYYSV

SEQ ID NO: 10459 - protein, 292 aa, Hordeum vulgare
MARMGASVLSILLASCALAAASFDKEFDVTWGDGRGKILNNGQLLTLGLDKVSGSGFQSKHEYLFGKIDMQLKLVPGNSAGTVTAYYLSSQGPTHDEIDFEFLGNVTGEPYTLHTNVFTQGQGQREQQFRLWFDPTNDFHTYSILWNPKHIIFMVDDMPIRDFKNLEGKGIAFPKNQPMRLYSSLWNADDWATQGARVKTDWSHAPFSASYRGFKADACVVTAGGRPRCGASMGTEAAPGTGASGAAGEWYNQELDLTLQQRMRWVQSNYMIYNYCTDPKRVAKGVPAECSM

SEQ ID NO: 10460 - protein, 208 aa, Oryza sativa (japonica cultivar-group)
MAMQVAAPSRRRPSLGRQKIEIRRIESEEARQVCFSKRRAGFFKKASELSILCSADVAAVVFSPAGKAYSFGHPSVECLLERFLPDSSSGAAARVRRGANNNGGGGMVGELNRQYGELRAMVEAHKARRERADEKIEMERAAGRWLPMDADVRRMSPEELMAFGTGLMAVQAAVSARADQMLRDALLIGRRPPTTTTAGFGFFHMPHY

SEQ ID NO: 10461 - protein, 122 aa, Oryza sativa; identical to SEQ ID NO: 6793

SEQ ID NO: 10462 - protein, 138 aa, Kluyveromyces delphensis
MSKVPRNFRLLEELEKGEKGLGPESCSYGLADSDDITMTNWNGTILGPPHSNHENRIYSVSIECGPQYPDEPPKITFVSKINLPCVDQTTGEVKREKFHTLRDWKRLYTMEAILLDLRKEMASPANKKLPQPEEGSTF

SEQ ID NO: 10463 - protein, 316 aa, Glycine max
  unsure (1)..(316): unsure at all Xaa locations
MLRMERPMLICLMSLLLNIAVRPPWIPRTPMKGQIWFLIIPPTCPPTRPPTRPINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYXYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 10464 - protein, 517 aa, Blumeria graminis
MSESIGPTRTLKRKNVKGLALSAPPRIVAPSDGDSQQPGGIGGENTRQTSQLEIGIEYKLDLKREDLEVLKDLGHGNGGTVSKVRHMATGTVMARKIIHVEANKEMRRRIVRELQIMHETNSEYIVTFYGAFLSETNDVIMCMEYMDVGALDRVSRKFGPVRVDVLGKIAEATLGGLTYLYTKHHIMHRDIKPSIILINSKGQIKLCDFGVSGELVNSVADTFVGTSTYMAPERIQGQKYTVKSDVWSFGLSIMELAIGKFPFDTSEQLSDDEGAPAGILDLLQQIVYEPAPRLPKSEAFPQILEDMIQKCMAKEPQERPTPQELYEREPFVQAAKRTPVNLKEWAVGLMEKDNRKSHLGPQLSPSTQQLLRSCDSPTAMRLNSPNNALPTPTSGDIPIGGDVRSAATSPTHEDSTNHSRLSTKLSSSQSRSHSGSSSQNSRHVSNNSATLAIPDRQSNIPSGKGVVFTSTKLPIRPAPSGPLPPPPVPRKEGTESDLRNLNRRQATFGNNGYGPGF

SEQ ID NO: 10465 - protein, 234 aa, Glycine max
  unsure (1)..(234): unsure at all Xaa locations
GQLTGENKINRQVTFAKRMNGLLKKAYELSVLCDAEVALIIFSNRGKLYEFCSSSSMLKTLERYQKCNYGAPEANVSTREALELSSQQEYLKLKARYESLQRSQRNLMGEDLGPLSSKELESLERQLDSSLKQIRSTRTQFMLDQLSDLQRKEHLLSEANRSLRQRQLEGYQINPLQLNPGVEEMGYGRHPAQTHGEALFQQMECEPTLQIGGXAGPSMSNYMAGWLPYLPCMK

SEQ ID NO: 10466 - protein, 512 aa, Brucella suis 1330
MKIRAQIGMVLNLDKCIGCHTCSITCKNVWTNREGVEYAWFNNVETKPGVGFPKEWENQKKWNGGWVRKKNGKIEPKMGAKWRILAKIFANPDLPEIDDYYEPFDFDYGHLQTAGESRTMPTARPRSLISGERMEKIEWGPNWEEILGGEFAKRSKDYNFEGVEKEIYGQFENTFMMYLPRLCEHCLNPTCVAACPSGAIYKREDDGIVLIDQEKCRGWRMCVSGCPYKKIYYNWSSGKSEKCIFCYPRIESGQPTVCSETCVGRIRYLGVMLYDADRISEAASTANEQDLYQEQLNIFLDPNDPAVIEQARKDGVPDAWLEAAKHSPVYKMAMDWKIAFPLHPEYRTLPMVWYVPPLSPLQSAAQAGKLGMDGPLPDVRSMRIPVRYLANLLTAGKEKPVISALERMLAMRAYMRAKTIDGVIDEAIADRVGMSGAMIEEMYNIMAIANYEDRFVIPTSHREITEDAYDVRGSCGFTFGNGCSGGTSTEDLFGAKRQKVVQTPTDIFREQV

SEQ ID NO: 10467 - protein, 128 aa, Triticum aestivum
MAGACAVAAPSRATVSGPGAAPPPGRGSRVSCRRSARRRAGGRARVSRDTNGAEAEPDSKGPIPQDDSGYLLTLGLGSIGGAAAVKYGSVLLPDITRPNIVEALLMVSLPMAAAVLVLLKLSSTSTHD

SEQ ID NO: 10468 - protein, 321 aa, Actinobacillus pleuropneumoniae serovar 1 str. 4074
MTKKLLILHTGGTISMSEGEDGKVSPSEKNPLLAALERLNHPAQLSQESVLNVPSPHITLQHWLLLKTRIEKAVNEEQYDGIVITHGTDTLEETAYFLDLALNVNVPVAITGAMRSSNELGSDGLINLQSAILVALCPESRNKGVLVVMNDEIHNAKFVTKTHTTNVATFQTPTFGPCGLIAKNRVLYFQQLTEYERFPIQTVTRTNVQLVKAYAGMDSFLLEQLAHHGCNGVVIEALGAGNLPPSCLAGLDALLRADIPVVLVSRAFNGVTQDVYDYLGGGKQLKQQNVIFTTGLSGQKARIKLLVLLNQNLSKPLAEYF

SEQ ID NO: 10469 - protein, 198 aa, Yersinia ruckeri
SSIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAHAY

SEQ ID NO: 10470 - protein, 138 aa, Trichodesmium erythraeum IMS101
MLGSRHVPITHQQLIELLSYALVLGSNHIITSGATGTNLAVVRGAMRADPNLVTVILPQSLERQPRESRKELEKVIHVVENPKNNQLSLAEASSICNQEIVSRCQQLICFAFHDSHTLLKTCQDAEEQRKVVTLFYLD

SEQ ID NO: 10471 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 10472 - protein, 303 aa, Erwinia chrysanthemi
MSTVNKKVKKAVIPVAGLGTRMLPATKAIPKEMLPLVDKPLIQYVVNECIAAGINEIILVTHSSKNSIENHFDTSFELEAMLEKRVQRQLLKEVQSICPEHVTIMQVRQGLAKGLGHAVLCAHPLVGDEPVAVILPDVIIDEYESDLKKDNLSEMLQRFYSTGHSQIMVEPVENVSSYGVVDCKGVELKPGDSAPMVGVVEKPKASEAPSNLAVVGRYVLSEHIWDLLKKTEPGAGNEIQLTDAIAMLMEKETVEAYHLKGVSHDCGNKLGYMTAFVEYGLRHDALGEDFTQWLKEAIEEDAN

SEQ ID NO: 10473 - protein, 770 aa, Lycopersicon esculentum
MNDIGMAYNNHFSIIGFILLSSLLKQVLAQNSPVFACDVTSNPALGNLTFCDASLAVENRVNDLVNRLTLGEKIGFLVSGAGGVSRLGIPKYEWWSEALHGVAYTGPGVHFTSLVPGATSFPQVILTAASFNVTLFQTIGKVVSTEARAMYNVGLAGLTYWSPNVNIFRDPRWGRGQETPGEDPTLTSKYGVAYVEGLQQTDDGSTNKLKVAACCKHYTAYDVDNWKGIERYSFNAVVRQQDLDDTFQPPFRSCVLEGAVASVMCSYNQVNGKPTCGDPNLLAGIVRGEWKLNGYIVTDCDSLQVIFKSQNYTKTPEEAAALGLNSGVDLNCGSWLSTYTQGAVNQKLVNESVIDRAISNNFATLMRLGFFDGNPKSRIYGNLGPKDVCTPENQELAREAARQGIVLLKNTAGSLPLTPTAIKSLAVIGPNANVTKTMIGNYEGIPCKYTTPLQGLTASVATIYKPGCADVSCNTAQIDDAKQIATTADAVVLVMGSDQSIEKESLDRTSITLPGQQSILVAEVAKVAKGPVILVIMSGGGMDVQFAVDNPKITSILWVGFPGEAGGAALADVIFGYYNPSGRLPMTWYPQSYADVVPMTDMNMRPNPATNYPGRTYRFYTGPTVFTFGHGLSYSQFKHHLDKAPQFVSLPLGEKHTCRLSKCKTVDAVGQSCSNMGFDIHLRVKNVGKISGSHIIFLFTSPPSVHNAPKKHLLGFEKVHLTPQGEGVVKFNVNVCKHLSVHDELGNRKVALGPHVLHIGDLKHSLTVRI

SEQ ID NO: 10474 - protein, 1250 aa, Oryza sativa
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGFCIMILQAGYRFLEDRGISLSLPSSCIDNAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVPKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSET

SEQ ID NO: 10475 - protein, 207 aa, Vicia faba
DYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKGGCCSA

SEQ ID NO: 10476 - protein, 132 aa, Triticum aestivum
  unsure (1)..(132): unsure at all Xaa locations
RRSLMXEXSSEFVEXKVAYALAQGXKVIACVGXTLEQRXAGSTMEVVAEQTKAITGKIKDWTNVVVAYEPVWAIGTGKVATPAQAQEVHANLRDWLKTNVSPEVAASTRIIYGASLKPEFIDIINAATVKSA

SEQ ID NO: 10477 - protein, 256 aa, Glycine max; identical to SEQ ID NO: 1852

SEQ ID NO: 10478 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 10479 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 10480 - protein, 348 aa, Corynebacterium glutamicum ATCC 13032
MVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 10481 - protein, 164 aa, Lactobacillus delbrueckii subsp. lactis
RLRILVMNYPTNPTGVMYSQEELDALAAVIKDRPTFVLCDEIYSELNYDQEHASMAKSLRSQAIVLNGVSKSWAMTGYRIGIMAAPQEITDQLAKVHQFITTTEPTPMQDAAEEAFKNGDRDAREMKAAFKERRDYLYQALTETGFEVVKPQGAFYIWAKIPAG

SEQ ID NO: 10482 - protein, 172 aa, Triticum aestivum
MDSGSRSSGGAGFDDDDGLAARREVSSSLQELAVRVDAKGGSCSGSGTDQLPNTPKSKHSATEQRRRSKINDRFQILRDLLPHTDQKRDKATFLLEVIEYIRFLQEKAQKYEASFPEWNQENAKLLPWSNMYFRSSWKNAQSKGQIAEDASPHPSQFIKKWGLPWIQYHRQA

SEQ ID NO: 10483 - protein, 843 aa, Uromyces viciae-fabae
MKTPLGIGSTAAVLYILSNISHVQLATTSPSENQNQSYNPQIEGLTVQPSTVANGLRINSNSLISNFDFEIIQPPPGYEEWTSPVVLPAPVQSGLSPWSESIVRARAFVAQLTIEEKVNLTTGAGTQGRCVGETGTVPRLGFNQPICLQDGPVGIRYTDFNSVFPAAINVAATFDKQLMFKRAQAMAEEFRGKGANVVLAPMTNLMRTPQAGRAWEGYGSDPYLSGVATVQSVLGIQSTRASACVKHYIGNEQEHYRGGSGATASSSNIDDRTLRELYEWPFAEAIHAGVDYIMCSYNRVNQTYACENSKLINGIAKGEHKFQGVMVTDWAAAESGVRTALAGTDMNMPGFMAYGQPSEPNPSTANGSYWGLRMIEAVKNGTVPMERLDDMVTRVISTYYKQGQDKSDYPKLNFMSMGQGTPAEQAVSNHHVNVQKDHYLIIRQIATASTILLKNVNHTLPLKSPDKMRSVVVVGSDAGDNPQGPNSCVDRGCNRGILAIGWGSGTANFAHLTAPATSIQNYLLQSNPTITYRSIFDDYAYDEIAKAASTADVSIVHVSSDSGEGYLTVEGNQGDRSNTSLWNKGDELILKAAEACNNVVVVIHSVGPVDMEAWINHPNVTAVLLAGLPGQEAGSAEVDVLWGSTNPSGRLPYTIAKKPSDYPAELLYESNMTVPQINYSERLNIDYRHFDTYNIEPRFEFGFGLSYTTFAWNSLKFSSSFQLQKTSPVIVPPNLDLYQDVIEFEFQVTNSGPFDGSEVAQLYVDFPNQVNEPPKVLRGFERAYIPSKQSKTIEIKLRVKDLSFWDVITQSWQIPDGKFNFMIGSSSRKIIFTQEISLQHSHM

SEQ ID NO: 10484 - protein, 464 aa, Oryza sativa
  unsure (1)..(464): unsure at all Xaa locations
MGQGTPGGMGKQGGAPGDRKPGGDGDKKDRKFEPPAAPSRVGRKQCKQKGPEAAARLPNVAPLSKCRLRLLKLERVKDYLLMEEEFVAAQERLRPTEDKTEEDRSKVDDLRGTPMSVGSLQEIIDESHAIVSSFVGPEYYVGILSFVDKDQLEPGCSILMHNKMAVRCQCLYKAAFQVLSVVGILQDEVDPMVSVMKVEKAPLEXSYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGXFDSRGDVKVILATNRIESLDPALLRPGRIDRKIEFPLPDIKTRRRIFQIHTSKMTLADDVNLEEFVMTKDEFSGADIKAICTEAGLSRLVXARMKVTHADSMKAKEKVMFKKKEGVPEGLYM

SEQ ID NO: 10485 - protein, 339 aa, Pseudomonas putida KT2440
MSNESINWDKLGFDYIKTDKRYLSVWRNGEWDKGTLTEDNVLHISEGSTALHYGQQCFEGLKAYRCKDGSINLFRPDQNAARMQRSCARLLMPHVPTDVFIEACKQVVKANEKFVPPHGKGALYLRPFVIGTGDNIGVRTAPEFIFSVFAIPVGSYFKGGMKPHNFQISSFDRAAPQGTGAAKVGGNYAASLQPGAEAKKANFADAIYLDPLTHTKIEEVGSANFFGITANNEFVTPKSASVLPGITRLSLMELAQSRLGMTVIEGDVEISKLDRFVEAGACGTAAVITPIGGIEYNGKLHVFHDLEKVGPVTQKLYNELTGIQSGDVEAPAGWIVKVA

SEQ ID NO: 10486 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYSVEHSDLLLAFGVRFDDRVTGKLEAFASRAKIVHIDIDSAEIGKNKTPHVSVCGDVKLALQGMNEILENRAEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIXVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 10487 - protein, 373 aa, Zea mays
  unsure (1)..(373): unsure at all Xaa locations
LQWAGTASIDFSLAQLIQVIVLLSTGGNNGGGYLASKHVVFAFHAGILLSHAVINSLSITWLSLLGQFAALWSMLGVLVLMIAVPVVATERASAKYVFTHFNTDNSAGIHSNLYIFVLGLLMSQYTLSGYDASAHMTEETKNAGRNGPVGIITAIGVSLVVGWGYILGITFAVKDIPALLSTGNDAGGYAIAQVFYLAFKGRYGNGAGGIVCLXWVVAVAVYFCGMSSMTSNSRMTYAFSRDGAMPFSSVWHKVNEQEVPVNAVWLSAFVSLCMALPSLGSLVEYQAMASVATTGVYIAYALPILLRVTLAHGRFVFEPXSLGRYGVLVGWTDVLWVATITVLFSLPVSYPVTKDTINYTPGARDAGLFVLIL

SEQ ID NO: 10488 - protein, 832 aa, Triticum aestivum
MSAADKVKPAASPASEDPSAIAGNISYHAQYSPHFSPLAFGPEQAFYATAESVRDHLLQRWNDTYLHFHKTDPKQTYYLSMEYLQGRALTNAVGNLAITGAYADALKKFGYELEAIAGQERDAALGNGGLGRLASCFLDSMATLNLPSWGYGLRYRYGLFKQRIAKEGQEEIAEDWLDKFSPWEIVRHDVVYPIRFFGHVEISPDGKRKWAGGEVLNALAYDVPIPGYKTKNAISLRLWDATATAEDFNLFQFNDGQYESAAQLHSRAQQICAVLYPGDATEEGKLLRLKQQYFLCSASLQDIIFRFKERKADRVSGKWSEFPSKVAVQMNDTHPTLAIPELMRLLMDVEGLGWDEAWAVTNKTVAYTNHTVLPEALEKWSQAVMKKLLPRHMEIIEEIDKRFREMVISTRKDMEGKIESMRVLDNNPEKPVVRMANLCVVAGHTVNGVAELHSNILKQELFADYVSIWPNKFQNKTNGITPRRWLRFCNPELSEIVTKWLKTDQWTSNLDLLTGLRKFADDEKLHAEWAAAKLASKKRLAKHVLDVTGVTIDPDSLFDIQIKRIHEYKRQLMNILGAVYRYKKLKEMSAADRQKVTPRTVMVGGKAFATYTNAKRIVKLVNDVGAVVNNDADVNKYLKVVFIPNYNVSVAEVLIPGSELSQHISTAGMEASGTSNMKFSLNGCVIIGTLDGANVEIREEVGQDNFFLFGAKADQVAGLRKDRENGLFKPDPRFEEAKQFIRSGAFGTYDYTPLLDSLEGNTGFGRGDYFLVGYDFPSYIDAQARVDEAYKDKKKWVKMSILNTAGSGKFSSDRTIDQYAKEIWGISACPVP

SEQ ID NO: 10489 - protein, 424 aa, Batrachospermum deminutum
  unsure (1)..(424): unsure at all Xaa locations
IEASAAVAGESSTATWTVVWTDLLTACDLYRAKAYKVDAVPSTSDQYFAYIAYDIDLFEEGSIANLTASIIGNVFGFKALKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAATGEIKGHYLNVTAATMEDMYERAAFAKELGSVICMVDLVIGYTAIQTMSVWARKADMILHLHRAGNSTYSRQKIHGMNFRVICKWMRMAGVDHIHAGTVVGKLEGDPLMIKGFYNTLLLSHLDVNLPQGIFFEQDWASLRKVTPVASGGIHCGQMHQLLDYLGDDVVLQFGGGTIGHPDGIQAGATANRVALESMVLARNEGRDYVNEGPQILREAAKTCGPLQTALDLWKDISFNYXSTDTA

SEQ ID NO: 10490 - protein, 149 aa, Oryza sativa
RNLMDMKIFVDTDADIRLARRIRRDTVERGRDVSSVLEQYGRFVKPAFDDFVLPSKKYADVIIPRGGDNHVAIDLIVQHIRTKLGQHDLCKIYPHVYVVQTTFQIRGMHTLIRDRDITTPDFVFYSDRLIPLVVEHGLGHLPFTEKQII

SEQ ID NO: 10491 - protein, 150 aa, Triticum aestivum
  unsure (1)..(150): unsure at all Xaa locations
MIHPKKLAQLVKKCQRMLAAGAGARRRHASADDECCSTASVAADEGHCVMYTTDGARFEVPLAYLGTTVFAELLRMSEEEFGFTSGGDGGRIMLPCDATVXEYVLCLVRKEASEEVEKAFLSSIAGHCHNYNASCMAPSMGITRQFALCT

SEQ ID NO: 10492 - protein, 315 aa, Staphylococcus aureus subsp. aureus Mu50
MSWPLKHGKGAYMSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFRLQHHL

SEQ ID NO: 10493 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELEESHHSFVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 10494 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGQSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 10495 - protein, 389 aa, Oryza sativa
MADEKLAKLREAVAGLSQISDNEKSGFISLVARYLSGEEEHVEWAKIHTPTDEVVVPYDTLAAPPEDLEETKKLLNKLAVLKLNGGLGTTMGCTGPKSVIEVRNGFTFLDLIVIQIESQYPRVVADEFLPWPSKGKTCKDGWYPPGHGDIFPSLMNSGKLDLLLSQVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 10496 - protein, 127 aa, Glycine max
MHRQSLGSPSPKLPKLETLVTDEDDAPKPHRLSLSPPPPPPHKFVHLIPVLTLLCFFVLYLFSHTPSPSDLNHFTGFNRSPSHRLDLAEKIGGDIGQYMDVKRSDVLAIRSLQQIPKPRPHRKLADF

SEQ ID NO: 10497 - protein, 802 aa, Glycine max
MATPILYNVPSLGHHPRSHLLFPSLPQMSSTFSPLLNLIAVFLLLFLVRHTCEARDPFACDPKNGATENMPFCKASLAIPERVKDLVGRLTLQEKVRLLVNNAAAVPRLGMKGYEWWSEALHGVSNVGPGVKFNAQFPGATSFPQVITTAASFNASLWEAIGQVVSDEARAMYNGGTAGLTYWSPNVNIFRDPRWGRGQETPGEDPVLAGTYAASYVRGLQGTDGNRLKVAACCKHFTAYDLDNWNGMDRFHFNAQVSKQDIEETFDVPFRMCVSEGKVASVMCSYNQVNGVPTCADPNLLKKTVRGLWQLDGYIVSDCDSVGVFYDNQHYTPTPEEAAADAIKAGLDLDCGPFLAVHTQNAVEKGLLSEADVNGALVNTLTVQMRLGMFDGEPSAHAYGKLGPKDVCKPAHQELALEAARQGIVLLKNTGPVLPLSPQRHHTVAVIGPNSKATVTMIGNYAGVACGYTNPLQGIGRYAKTIHQLGCENVACKNDKLFGSAINAARQADATVLVMGLDQSIEAETVDRTGLLLPGRQQDLVSKVAAASKGPTILVIMSGGSVDITFAKNNPRIVGILWAGYPGQAGGAAIADILFGTTNPGGKLPVTWYPQEYLTKLPMTNMAMRGSKSAGYPGRTYRFYNGPVVYPFGHGLTYTHFVHTLASAPTVVSVPLNGHRRANVTNISNRAIRVTHARCDKLSISLEVDIKNVGSRDGTHTLLVFSAPPAGFGHWALEKQLVAFEKIHVPAKGLQRVGVNIHVCKLLSVVDKSGIRRIPLGEHSFNIGDVKHSVSLQAAALGIIKS

SEQ ID NO: 10498 - protein, 297 aa, Erwinia chrysanthemi
MKLKDFAFYAPCVWGTTYFVTTQFLPADKPLLAALIRALPAGIILILGKNLPPVGWLWRLFVLGALNIGVFFVMLFFAAYRLPGGVVALVGSLQPLIVILLSFLLLTQPVLKKQMVAAVAGGIGIVLLISLPKAPLNPAGLVASALATMSMASGLVLTKKWGRPAGMTMLTFTGWQLFCGGLVILPVQMLTEPLPDLVTLTNLAGYLYLAIPGSLLAYFMWFSGLEANSPVIMSLLGFLSPLVALLLGFLFLQQGLSGAQLVGVVFIFSALIIVQDISLFSRRKKVKPLEQSDCVIK

SEQ ID NO: 10499 - protein, 328 aa, Pseudomonas stutzeri
CIGCHTCSITCKNVWTSREALEYAWFNNVETKPGIGYPKEWENQDKWKGGWVRNGDGTINPKIGGKFRVLANIFANPDLPTIDDYYEPFDFDYQNLHTAPISEHQPVARPRSLISGQRMEKIEWGPNWEEILGTGSAKRRKGKNFDKVQADIYGQYENTFMMYLPRLCEHCLNPACAASCPSGAIYKREEDGIVLIDQEKCRGWRMCISGCPYKKIYLNWKSGKSEKCIFCFPRIEAGMPTVCAETCVGRIRYLGVLLYDADRIHEVASTVNEQDLYAKQLEIFLDPFDPKVIEQALNDGVPMSVIEAAQKSPVYKMAVDWKHGACRC

SEQ ID NO: 10500 - protein, 284 aa, GIBBERELLA ZEAE PH-1
MPSSRSADCTSAMSIEHYNSSVASEYIVDSDLPPLSRANSSHDEERYPYRAVETCGGCMNDFPEDETAVMACTHEFCEPCFSLMIERSLDGSSAFPPRCCDILFTRDYVYPHISKETIRRFEEKQIIYETLDRTYCSNVECQTFIPPWTIESDIGYCPSCPQRTCAKCKNPEHTGRCVVDKGKNKLLALAKKKGWKPCPRCGQLINKTSGCEHVICPCGNEFCFHCGADFAGHICPREGLCTSICIDLLVDAGRCALRGLFMPVRWTRRRLRDQAQNEAVSNYW

SEQ ID NO: 10501 - protein, 311 aa, Oryza sativa
MASEVEDDAAAVLTNGGAGAAEVRRRRDQAKEILSKQAVKIATKAEEHERFIFKVTHLLGVLGFGTFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPVNVLRRQRLLKDPEVMTSYRELSKKAQKANNIWWRLSGLLGDRNRPLMYILLQALFTVATMALTVPIFLSFQMHVVFQILKVCASTWNGGSFILEVMPRQVVQKEKKKLEMKPMEEANSSQNAEESQGDLSANGQHSSEHS

SEQ ID NO: 10502 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 10503 - protein, 463 aa, Chondracanthus intermedius
MGYWDPDYVVKDTDVLALFRVSPQPGVDPVEASAAVAGESSTATWTVVWTDLLTACDLYRAKAYKVDSVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAAAGETKGHYLNVTAATMEEMYERAEFAKELGSIIVMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGPQILQDAAKTCGPLQTALDLWKDITFNYTSTDTADFVETPTANV

SEQ ID NO: 10504 - protein, 408 aa, Oryza sativa; identical to SEQ ID NO: 8915

SEQ ID NO: 10505 - protein, 107 aa, Glycine max
  unsure (1)..(107): unsure at all Xaa locations
TYRTRVGVFCTPQPKGDPVLEAITHRKWQELMASHGGAGNQQNPVQEKAHDDXAQREAEERRQMMLSQILSAEAREKLARIALVKPEKARGVVDFILRAAQMGQITE

SEQ ID NO: 10506 - protein, 295 aa, Bacteroides thetaiotaomicron VPI-5482
MKGIVLAGGSGTRLYPITKGVSKQLLPIFDKPMIYYPISVLMLAGIREILIISTPYDLPGFKRLLGDGSDYGVHFEYAEQPSPDGLAQAFIIGEEFIGNDSVCLVLGDNIFYGQGFTHMLKEAVHTAEEENKATVFGYWVADPERYGVAEFDKIGNVLSIEEKPIQPKSNYAVVGLYFYPNKVVEVAKNITPSSRGELEITAVNQQFLNDQELKVQLLGRGFAWLDTGTHDSLSEASTFIEVIEKRQGLKVACLEGIALRHGWITTDKMRELAQPMLKNQYGQYLLKVIDELTQK

SEQ ID NO: 10507 - protein, 159 aa, Oryza meridionalis
MEELEGHRGAGRLPPPPPLLPFPKVSVQVYTVPSSSTAAAGGARQAVAPATRDGGGGGRAAGVLDDPVKARIVSHPRYHRLLAAFLDCHKVGCPAEAAEEIAAAARVREARQRAAAAASHMPPAPDDPELDQFMEDYCKLLVECKEELSRPLQEAEEFL

SEQ ID NO: 10508 - protein, 512 aa, Candida tropicalis
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 10509 - protein, 337 aa, Cryphonectria parasitica
MVVKVGINGFGRIGRIVFRNAHEHSDVEIVAVNDPFIEPHYAAYMLKYDSQHGNFKGDVTVEGSDLVVGGKKVRFYTERDPAAIPWSETGADYIVESTGVFTTTEKAKAHLKGGAKKVIISAPSADAPMYVMGVNEKTYDGSGMVISNASCTTNCLAPLAKVINDEFKIIEGLMTTVHSYTATQKTVDGPSAKDWRGGRTAAQNIIPSSTGAAKAVGKVIPELNGKLTGMSMRVPTSNVSVVDLTVRIEKGATYEQIKTAVKKAADGPLKGVLAYTEDDVVSTDMNGNPNSSIFDAKAGISLNDHFVKLVSWYDNEWGYSRRVLDLISHVAKVDGNA

SEQ ID NO: 10510 - protein, 468 aa, Methanosarcina acetivorans C2A
MNSILISDSFWGKSMKIKSINPYTEEINRTYGSFPIEECRNRIEKSRAAFSGWSSLPAEERAKFFLNVAELLRRNTEIYAGIITEEMGKPIRQSRSEVQKCVRLCDYYAENAAGLLKAEIVELGAEKSYVTFEPLGVVFGIMPWNFPFWQVFRFAVPAICAGNVCVLKHASNVPGSALEIEKIFLEAGFREYVFKTLLIDSKTAMEIIKEELVDGVSLTGSTGAGSKIGKLAGEAIKPQVLELGGSDPFIVLEDADIERAAQAGVRSRFLNAGQSYTAAKRFIVVEEVVGDFIEAFELHMQELKIGDPIDEETDIGPLAKKEFVEILEKILEDARKKGAEPQTYGEKHKKGFFFNPTIIPAASTYMEVCNIEVFGPVAPVITAKDEDEAVEVANSIEFGLGAKIWSGDLERAEKLAKRIRAGSVAVNGMIRSDPRLPFGGTGKSGVGRELSHYGLKEFVNIKTVVVNK

SEQ ID NO: 10511 - protein, 757 aa, Betula platyphylla
  unsure (1)..(757): unsure at all Xaa locations
MWKLKIAEGGSPWLRTLNNHVGRQVWEFDPKLGSPEELAEIERARETSLKVRFEKKHSSDLLMRIQFAKENPRGAVLPQVKVNETEDVTEEMVTRMLRRAISFHSTLQAHDGHWAGDYGGPMFLMPGLVITLSITGALNTVLSEEHKKEMCRYLYNHQNKDGGWGLHIEGPSTMFGTVLSYVTLRLLGEGANDGQGAIERGRKWILDHGSATAIISWGKMWLSVLGAFEWSGNNPLPPEIWLLPYMLPVHPGRMWCHCRMVYLPMSYLYGKRFVGPITPTVMSLRKELYSVPYHEIDWNQARNLCAKEXLYYPHPLVQDILWASLHKLVEPVLMRWPGKRLREKALRTVLEHIHYEDENTRYICIGPVNKVLNMLCCWVEDPNSEAFKLHLPRINDYLWIAEDGMKMQGYNGSQLWDTAFAVQAIISTNLFEEYGPTLEKAHMYIKKSQVREDCPGDLDFWYRHISKGAWPFSTADHGWPISDCTAEGLKAALLLSKIPPDVVGEPLVEERLYDAVNVILSLQNADGGFATYELTRSYPWLELINPAETFGDIVIDYNYVECTSAAIQALTSFKKSYPKHREEEVDVCIKRAAMFTEKIQASDGSWYGSWGVCFTYGTWFGVKGLVAAGKNFNDCFGIRKACDFLLSKQLPSGGWGESYLSCQNKVYSHVEGNRSHVVNTGWAMLALIEAGQAERDPTPLHRAARVLINSQMENGDFPQEEIMGVFNRNCMITYAAYRNIFPIWALGEYRCRVLQAP

SEQ ID NO: 10512 - protein, 617 aa, Bacillus anthracis str. A2012
MLLYEKAHEEIVRRATALQTMQWQDGTWRFCFEGAPLTDCHMIFLLKLLGRDKEIEPFVERVASLQTNEGTWKLHEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYLYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 10513 - protein, 577 aa, Oryza sativa
MATDTAAPAAMKVDGSALAGRALAAAGARHMFGVVGIPVTSLASRAAAAGVRFLAFRNEQSAGYAAAAYGFLTGSPGLLLTVSGPGCVHGLAGLSHATANAWPLLMVSGSCSQPDAGRGDFQELDQIAATKPFIKIAVKATTIADIPRLVFQALAATVSGRPGGCYLDIPSDVLHQTLTESEAAALIDAAAADSAKSDSSPPKHKSLDEGIEKAAELLRRAERPLVVFGKGAAYSRAEDAIWKLVDTTGIPFLPTPMGKGVVPDTHPLSATAARSLAIGQCDVALVVGARLNWLLHFGEPPKWSKDVKFILVDVCEEEIELRKPHVGIVGDAKRVVELINREIKDQPFCLAPSHPWVEAITKKARDNVLKMEAQLAKDVVPFNFLTPLRIIRDAILAEGNPAPVVVSEGANTMDVGRAVLVQNEPRTRLDAGTWGTMGVGLGFCVAAAVAEPDRLVVAVEGDSGFGFSAMEVETLVRYQLPVVVIVFNNNGVYGGDRRSPDEITGPYKDDPAPTSFVPAAGYHKMMEAFGGKGYLVETPDELKSALSESFRARKPAVINVIIDPYAGAESGRMQHKN

SEQ ID NO: 10514 - protein, 722 aa, Zea mays
MDDESKSAPKSDVNTDAGAEAAAAAAPLPPSSSETAETEARVEAADGESQVVERLVELVSEIAAISDFRNSYRRQFCNLSRRIRLLVPMLEEAKEAPTPLTVASEAALRRLREALHAARDLLQLGSSGSKIFLVLDREKIMKTFQDVTASLEQALAGISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEMGAQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSAAEHSNVLELLQKLSSQNLEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAHAQAQAQAQPQILVQAQAHADMQAERSLLPTSSDISDR

SEQ ID NO: 10515 - protein, 507 aa, Bifidobacterium longum DJO10A
MADTNVNGGTQQATGKLKSVESLDQTNEMERGLSNRHVQFIAIGGTIGTGLFLGSGKSISLTGPSIIFVYILVGVIMFFLMRAIGEMMYRDPSQHTFINFITRYLGNGWGHFAGWTYWAALVLLGMTEITAVSTYFITFFDTFGIDLTHWKWLIELCFLVSLVSINLIAVKVFGEVEFWFSMIKITLICAMIATAVVMIVIGYHYPAVQIHGVDHVSPAGHAGFDNLFAIFSFAPNGWMAFLMSFQMVFFAYEMIEFVGVTVSETKNPRKVLPKAINEIIVRVLIFYVGALVAIMCIVPWTSFKPNEDGSFASPFIMVFQYAGLNWASALVFFVVITAASSALNSLLYSAGRHLYQLSEVSPNPTLNKLGKVSDRKVPARAILVSAALILLSPIVNAIPGISGAFVLFSSASSAVFLFIYILTLLAHRRYRRSADFIADGFVMPAWKVLNTVAIVFFVFIYLTLFLADDTRNSAIAGLVWLVGFGGFSMLRERYRSRDLKAALEHKE

SEQ ID NO: 10516 - protein, 364 aa, Escherichia coli CFT073
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 10517 - protein, 487 aa, Caulobacter crescentus CB15
MSEPLLSADAWTDRLFSDGWVKPSGGVIAVQEPATETVLTQVGRADRSDVARAAASAKAAQPAWAALTADARQAILLRAADLLVEHAPDLAPWIMRESGSVAAKAAVELEHAAGFVRQAGAMATEAAGLVLPSSPGKTSIARRVPLGVVAVISPFNFPLVLSIRAVAPALATGNAVVLKPDPRTPISGGFLIARVFEAAGLPAGLLHVLPGDAEAGDALCRDPNIAMVAFTGSTGAGRKVGEVAGAHLKKVALELGGKNPLIILDDADPDVAASNAAWGAWLHQGQVCMTAGRLLVQRGIHDAVVERLAAKAGHLPVGDPMRGDVALGPLISRGQLDRVHAIVSDTVADGARLVAGGTHKGLCYAPTVLTGVAPGMRAFEEEIFGPIAAVTVFDDLDEAARLANDGPYGLSAGIISGSVGRAMTLGAKLEVGHLHINDQTVDAGPHSPFGGMKASGNGTRISGPANLDEFTTWRWETVKAAATAYPF

SEQ ID NO: 10518 - protein, 292 aa, Schedonorus arundinaceus
IELGLLEILVAAGGKSLTPTEVAAKLPSAANPEAPDMVDRILRLLASYDVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVKCILPVNPEANPSSQGVFHVDMIMLAHNPGGNQRY

SEQ ID NO: 10519 - protein, 338 aa, Zea mays
  unsure (1)..(338): unsure at all Xaa locations
MSGDRSPTVERRRXIRRLLLHPRGEASSSSPPPPAPAPEEGRRKGFATAALRGLGCTSASASQAYAPGEAAAAAAVRSSADWQGRRRRRGRDRRKERGGGGGGGFVTGGIGADVWCAPGIPFAAEXASSVNCVVARHQMLLRGGRGAEGDRSHRERPCLSRRVTVQEQISSSFMDSPPPPHLDAPLFGADLIPSGRLRRMRGWRHSPGGLEEEIRMFQTRVLLGGMNMYDRYQDWRLDVDNMTYEELLELGDKIGYVNTGLRDDEITRNLRKVKHPSFSSLRFATEMERKCSICQEEFETNEEMGRLDCGHSYHVYCIKQWLSQKNICPVCKTAVSKN

SEQ ID NO: 10520 - protein, 498 aa, Citrus sinensis
MGKVTVAATVVCAAAVCAAAALVVRRRMKSTGRWARAVAILKEMEEKCGTPIGKLRQVADAMTVEMHAGLASEGGSKLKMLISYVDNLPTGDEKGLFYALDLGGTNFRVLRVQLGGREGRVVKQEFEEVSIPPHLMTGSSHELFDYIAAALAKFVATEGEGFHVSPGRQRELGFTFSFPVRQTSIASGDLIKWTKGFSIEDTVGEDVVGELTKAMERIGLDMRVAALVNDTIGTLAGGRYHNKDAIAAVILGTGTNAAYVERAHAIPKWHGLLPKSGEMVINMEWGNFRSSHLPLTEYDEALDTESLNPGEQIFEKIISGMYLGEIVRRVLCRMAEEANFFGDTVPPKLKIPFILRTPHMSAMHHDTSPDLRVVGKKLKDILEISNTSLKMRKLVVELCDIVATRGARLSAAGIVGILKKLGRDTVRDGEKQKSVIALDGGLFEHYTKFSACMQSTVKELLGEEVSETVVIEHSNDGSGIGAALLAASHSQYLEVEES

SEQ ID NO: 10521 - protein, 470 aa, Gelidium latifolium
  unsure (1)..(470): unsure at all Xaa locations
GVIPYAKMGYWDPDYAVKETDVLALFRVTPQPGVDPVEASAAVAGESSTATWTVVWTDLLTACDLYRAKAYKVEEVPNSSDQYFAYVSYDIDLFEEXXXXXXXXXXXXXXFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMXXARNEGRSFVEEGPQILRDAAKTCGPLQTALDLWKDISFNYTSTDTADFVETPTANV

SEQ ID NO: 10522 - protein, 450 aa, Rhodobacter sphaeroides
MKKISQLMGLTALAAAAALPAWAQEAAEVVTEAAEAVVTPVMDKGDVAWMLMSTVLVFFMILPGIALFYGGLVRAKNMLSVLMQTTLIGCTVMVIWVIYGYSFAFGGGTSPFWGGMGKLFLAGVTTDSMAATFSDGFVIPEYLFICFQMTFAALTPALIIGGFAERIKFSAVLIFTVIWVTFAYFPIAHMVWDASGLIFNWGAIDFAGGTVVHINAGVAALIGAVMVGKRIGLGKENMAPHSMVMTMIGASMLWFGWFGFNVGSNLEANGGATLAMINTFVATAAAVVAWSLIEGLARGKASMLGAASGMIAGLVAVTPACGTIGPMGAIVLGAIASAVCYFFVTTVKNAMGYDDSLDVFGIHGVGGIIGAIGTGIFSAASLGGVNGDDYSIVGQTIIQAQAVVVTLIWTAIVSVVAFKIADLVVGLRVDTESERIGLDQTAHGESAYHG

SEQ ID NO: 10523 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 10524 - protein, 196 aa, Mitthyridium sp. Wall 2569
GGAKKVVISAPSKDAPMFVMGVNEEKYTNEDIVSNASCTTNCLAPLAKVINDKFGIFGGLMTTVHATTATQKTVDGPSNKDWRGGRSAGTNIIPSATGAAKAVGKVVPELNGKLTGMAFRVPTSDVSVVDLTVRLEKPASYDAIKAALKEASQGKMKGILGYTEDDVVSSDFITDSQSSIFDAKAGIALSDTFVKL

SEQ ID NO: 10525 - protein, 133 aa, Glycine max
MQGIGIGCCSNDVVGQLELSPTMSNSSSSLSMELDESPESRIQRLISEHPVIIFTRSSCCMCHVMKKLLATIGVHPTVIELDDHEIASLPLPDTTAPAAFIGGTCIGGLESLVALHVSGHLIPKLVQVGALWV

SEQ ID NO: 10526 - protein, 749 aa, Ajellomyces capsulatus
MTSKVEEGLQRVKELVENMQPGEQKVADLARDTTDVNGCLPFTTDHGVKVSNTDFWLRLASENQTGPLLLEDQIAREKIHRFDHERIPERVVHARGTGAFGHFKLFESAADVTSAGVLTDTSRTTPVFVRFSTVQGSKGSFDTVRDVRGFATKFYTEEGNWDLVGNNIPVFFIQDAVKFPDFVHAVKPEPHNEVPQGQTAHNNFWDFVYMHPEATHMFMWAMSDRAIPRSYRMMQGFGVNTFVLVNKQGKRHFVKFHWMPELGVHSLVPDESFKLGGQDPDFHRKDLMEAIDNKVYPKWKFGIQVLPEEKEHDFDFDILDPTKIWPESLIPVRYIGEMELNRNVDEFFPQTEQVAFCTAHIVPGIEFSGDPLLQGRNFSYFDTQITRLGVNWEELPINRPVCPVMNHNRDGAMRHKITQGTVNYWPNRFEACPPTKPEDGGFVTYPQKVEQSIKARMLSSKFREHINQAQLFYNSLSEYEKLHVNNAFCFELDHCDDPIVYNRLVSRISEIDHALAQAVAVKVGAPTPPRPGRDNPGQTTINLSQKYINDRQLSSPTIKGRRIAILIGDGYDSVAFGTVIAAVSAMGALPFIIGTKRQPIFADDEDRNHSKGVTPNHNYTSQRSTCFDATFIPGGSHIKELSQLGLIQHWVAEQFGHCKAIGATGEAINLIVQALSNLPDLEVASASSGHPVDWYGVVTSSKLHEPHSLTEGIKLFPEASDFLGKLFYQISQHRNYEREMAGLTDKVPF

SEQ ID NO: 10527 - protein, 259 aa, Poa annua
MGRGRVELKRIENKINRQVTFSKRRNGLLKKAYELSVLCDAEVALIIFSSRGKLYEFGSAGTTKTLERYQHCCYNAQDSNSALSETQSWYQEMSKLKAKFEALQRTQRHLLGEDLGPLSVKELQQLEKQLECSLSQARQRKTQLMVEQVEELRRKERQLGEINRQLKHKLDAEGSSSNNYRAMQQLTWAAGTVVDEGAAAYHMQHQQQQQPNHSAAMDCEPTLQIGYPHQFAAPEQAANNIPRSSGQGGENNFMLGWVL

SEQ ID NO: 10528 - protein, 255 aa, Triticum aestivum
RLCTCLPLPSIKSPFSIPISISKSVTMSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWG

SEQ ID NO: 10529 - protein, 499 aa, ASPERGILLUS NIDULANS FGSC A4
MAQQYKLPFELDNPDLLHFDSYVGNAWVTAKSGARFEVVDPGTDLPWASCPTNSAEDVDSAVQIAHDAFEKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITKTGTLTIDGQY

SEQ ID NO: 10530 - protein, 428 aa, Tropheryma whipplei TW08/27
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 10531 - protein, 143 aa, Glycine max
  unsure (1)..(143): unsure at all Xaa locations
MALNNGVPATGTGLIVSFGEMLIDFVPTVSGVSLAEAPGFLKAPGGAPANVAIAVSRLGGKAAFVGKLGDDEFGHMLAGILKENGVRADGINFDXGARTALAFVTLRADGEREFMFYRNPSADMLLKPEEIKNSHETITRKKK

SEQ ID NO: 10532 - protein, 338 aa, Blumeria graminis f. sp. hordei
MAPIKVGINGFGRIGRIVFRNAAQSCEVEVVAVNDPFIEPEYAAYMLKYDSTHGQFNGDIQTVEDGLVVNSRNVKFYNKRNPEEIPWAETGAEYIVESTGVFTTTEKAKAHLKGGAKKVIISAPSADAPMFVMGVNHKSYTTDLEVISNASCTTNCLAPLAKVINDEFTIIEGLMTTIHSYTATQKTVDGPSAKDWRGGRTAAQNIIPSSTGAAKAVGKVIPALNGKLTGMAMRVPTANVSVVDLTCRIEKSATYDEIKKAIKIAAGNELQGILSYTEDEIVSTDLIGNNHSSIFDAKAGISLNDNFVKLVAWYDNEWAYSRRVIDLISYIAGKDGSK

SEQ ID NO: 10533 - protein, 332 aa, Streptomyces griseus subsp. griseus
MDTFALIVTIGVALGFTYTNGFHDSAQRIATSVSTRALTPRAALAMAAVMNLAGAFLGQGVAKTVSEGLIATPVGQKGMGILFAALVGAIIWNLITWYYGLPSSSSHALFGGMVGAALAGGTDVIWSGVLKKVVIPMFISPFVGLIAGYLVMVGIMWIFRKSNPHKAKRGFRIAQTVSAAGMALGHGLQDAQKTMGIVVMALVIADVEGPNDEIPVWVKIACALMLSLGTYAGGWRIMRTLGRKIIELDPPQAFAAETTGASIMFGSAFLFHAPISTTHVITSAIMGVGATKRVNAVRWGVAKNIILGWFITMPAAALVAALSYGAVLLLFG

SEQ ID NO: 10534 - protein, 365 aa, Nostoc punctiforme
MLQQRSSSHPCCIEHKKLKTRRQKPMELAMIGLGRMGANMAQRLMRAGHHVVGYVRRTEKLSAMVNEGVIAAGASSIADLVSKLSKPRTVWLMVPAASVDETIETLIPLLEPDDIIIDGGNSYYHDDIRRAATLKDRGIHYVDCGTSGGVWGLERGYCLMIGGEQVAIKRLDPIFATLAPGVGEIDRTPGREKAGGTAEQGYLHCGPIGAGHFVKMVHNGIEYGVMAAYAEGLNILHHANIGNNQREIDAETTPLRNPEHYQYDFNLGDIAEVWRRGSVIASWLLDLTAIALLESPNLERFGGRVSDSGEGRWSAIAAIDESVPTPVLSAALFARFSSRGEADFADKLLSAMRYQFGGHYEKANS

SEQ ID NO: 10535 - protein, 288 aa, Triticum aestivum
MGGTHFADDDLAHEATGDGDVGRRDVGKMEHGCEHYRRRCKIVAPCCKEVFPCRHCHNDATALGDRHNICRQDVEKVVCVLCDTEQPVSQVCVRCGVNMGEYFCDVCKFYDDDTEKGQYHCHDCGICRVGGKENYFHCAKCGSCYAVALRDNHQCVEDSMRQNCPICYEYLFDSLKGTRVLNCGHTMHMDCFAEMVDHNKYTCPICSKTALDMTVHWGMLDQEIEATIMPPVYRYKVWVLCNDCNKVSEVDFHVIGHKCSHCNSYNTRSTSRPADLSGSSSPSTTDSS

SEQ ID NO: 10536 - protein, 338 aa, Escherichia coli CFT073
MQKKSIYVAYTGGTIGMQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAANYPINEVTLFFNNRLYRGNRTTKAHADGFDAFASPNLPPLLEAGIHIRRLNTPPVPHGEGALIVHPITPQPIGVVTIYPGISADVVRNFLRQPVKALILRSYGVGNAPQNKAFLQELQEASDRGIVVVNLTQCMSGKVNMGGYATGNALAHAGVIGGADMTVEATLTKLHYLLSQELDTETIRKAMSQNLRGELTPDD

SEQ ID NO: 10537 - protein, 159 aa, Shewanella oneidensis MR-1
MTLSSKDIGEGQLLSNQFVFNGFGCTGENISPQLAWRDAPEGTKAYAVTAYDPDAPTGSGWWHWAVYNIGGDQQQLAQGAGSKHNGLPKGAIALKNDFGTTDFGGACPPQGHGMHRYEFTVWALPNPLELPKDASPALLGFMLRAQALGSAKLTAVYHR

SEQ ID NO: 10538 - protein, 297 aa, Microbulbifer degradans 2-40
MSEQQEFRLSFEFFPPKTDVGREKLITVRKELNDIHPDFFSVTYGAGGSTRDNTKGIVKKMREEGLNVAPHLSFGGDTEQTILPLLQEYKDMGVDRIVALRGDMPSGVGGAQQLVYANELVAFIRKHFDDYFHLEVAAYPEIHPEATSYLDDVRYLKGKFDAGANSAITQYFFNPDAYFYFMDQCQKEGIDQPIYPGIMPILNYRNLARFSDSCGADIPRWMRKRMESFGDNQEALISFGIDWISELCDTLLDAGAPGLHFYTMNQTEPTATIIKNLGLEDAPDAQEHNHEGCGHEH

SEQ ID NO: 10539 - protein, 525 aa, Burkholderia fungorum
MRFLRFLKIFFTVIRFGLDEMMLSRVNDRRVRLLLRITTIGRKFDAPPGVRLRLALESLGPIFVKFGQVLSTRRDLLPVDIANELAKLQDQVPPFDSAVAIGLVEKSLGAPVDVLFDDFERVPVASASIAQVHFATVKAGQHAGKAVAVKVLRPNMLPVIDSDLALLRDIAVWAERLWADGKRLKPREVVAEFDKYLHDELDLMREAANGSQLRRNFAGLDLLLVPEMYWEFCTPTVLVMERMVGVPISQVETLRAAGVDIPKLAREGVEIFFTQVFRDGFFHADMHPGNIQVSLDPAHFGRYIALDFGIIGALSDFDKNYLAQNFLAFFKRDYHRVATLHLESGWVPPTTRVEELESAIRAVCEPYFDRALKDISLGQVLMRLFSTSRRFNVEIQPQLVLLQKTMLNVEGLGRSLDPELDLWKTAKPYLERWMNEQIGLRGWYERLKIEAPQWSKTLPQLPRLIHHALAERHDHTRGANDEMIRQILLEQKRTNRLLQGLLLFGVAVGVGAALARVFLALAYGG

SEQ ID NO: 10540 - protein, 328 aa, Zea mays
VEGELKELRIGETFEGLTGTSSLSTTNDDDASSTTTEAMFIISPNGKFKRKIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLYERNVIQREIKCTNILVHANGSVKLAGFGFAKELCLSMSKINMLRSCKGSVYWMAPEVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESSSPPAI

SEQ ID NO: 10541 - protein, 311 aa, Streptomyces coelicolor A3(2)
MTTVNHWTPGDIPDQAGRTALITGGNSGIGLETARALARHGARVILAGRSRTRLDQAAEAVRAATPEARTDTLVLDLSDLSSVRDAATRIAETETVDLLFNNGGVMNLPERRTTHDGLEMTVGTNHLGHFAFNAQVWPAVRRSPAPRVVTVSAIAARWPMGRLEDLMSEKSYRAMGAYAKSKRANIVYTLELARRTASSPVEALVVHPGAAMTNLQQHGTGPLSRMVTPIAARLLMGSAEGAAWPSLYAATSPHVQSGWFIGPAGRDQTSGTPRPAKLPTGADDPAEGRRLWAASEQLTGVPFDIEAEAAV

SEQ ID NO: 10542 - protein, 260 aa, Glycine max
  unsure (1)..(260): unsure at all Xaa locations
SARAKGEELKAMQVDTTVLGLSKDEAQKKPYIASMGVYVFKKEILLNLLRNMHREXLILFQSLFFKCYKLIXFRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVPIGIGENTKIKDCIIDKNARIGKNVVIANSEGIQEADRSSEGFYIR

SEQ ID NO: 10543 - protein, 192 aa, Buchnera aphidicola
MANLLLLDNIDSFTYNLVDQLRISQHKVIIYRNYVSTSIIIDALLKINNPILILSPGPGKPEEAGCMLKLLNILKGKIPIIGICLGHQAIIQIYGGEIGYAKKILHGKVSMISHDNKEMFLNIDNPFPVARYHSLICKRVPDKFIVSATFNKIIMAIRNDYERICGFQFHPESILTPQGTKLLNQTLNWAIK

SEQ ID NO: 10544 - protein, 231 aa, Schizosaccharomyces pombe
MDFALPTTASQASAFMNNSSLTFPVLPNANNEATNETADSGDAEVSKNEGVSGIVPTLQNIVATVNLDCRLDLKTIALHARNAEYNPKRFAAVIMRIREPKSTALIFASGKMVVLGGKSEDDSKLASRKYARIIQKLGFNAKFTDFKIQNIVGSCDVKFPIRLEGLAYSHGTFSSYEPELFPGLIYRMVKPKVVLLIFVSGKIVLTGAKVREEIYQAFEAIYPVLSEFRKH

SEQ ID NO: 10545 - protein, 282 aa, Oenococcus oeni MCW
MAEMQKGGVIMDVVNAEQAKIAEEAGATAVMALERVPSDIRKAGGVARMADPAIVEAVQNAVSIPVMAKARIGHIIEARILESMKVDYIDESEVLTPADDVYHIDKKAFTIPFVCGCRDLGEAARRIGEGAAMLRTKGEPGTGNIVEAVRHMRLVNNQVNKVLGMSPEEIMVFAKELGAPYDVLLEIKKSGRLPVVNFAAGGVATPADAALMMELGADGVFVGSGVFKSENPAKFAKAIVEATTYYKDYPRIAELSKGLGEPMKGIDMSILQPAEHMQERGI

SEQ ID NO: 10546 - protein, 418 aa, Archaeoglobus fulgidus DSM 4304
MRPKSWGWISMSERLEGKRVRIKAKGKIFEGIVMPSFTGNFVLKLDNGYNVGFKEYELLEVLEVEPFEPHLPELVKREGLPDVKIISTGGTIASKVDYRTGAVTSQFTAEEIASEVPELTEICNVDAELLYNILSENMKPENWIELARHVYKALKDHEGVIITHGTDTMHFSAAALSFMLSTPKPVVFVGAQRSSDRPSSDAAMNLLCAAKAATEDIGEVVVCMHGSTSDDYCLVHRGVKVRKNHTSRRDAFQSVNAKPIGRIDYPSLSVEWLSWRYRRGERELKLTDRLERKVVLIKFFPGLSSDILEYYHSKGYRGFVIEGTGLGHVSTDWIDTLRRVCEDSVVVMTSQCLWGRVCDRVYDTGRDILRAGVIEGEDMLPEVALIKLMWLLGNYSIEEAKEMVKKSVAGEIEPTTQY

SEQ ID NO: 10547 - protein, 841 aa, Oryza sativa; identical to SEQ ID NO: 7321

SEQ ID NO: 10548 - protein, 367 aa, Glycine max
MSTPLFHEFKRQASFFFKEKIGCIPNGITSDMSIALNKTNSSKMSTPLFHEFKKQASFFFKEKIKTARLALTDVTPAELMTEEATSGNPWAPDARTLRSISRDAFELDDYWRIVEILHKRFLKFEKKNWRISYNSLIVLEHLLTHGPESVAEEFKSDKDVISQMKGFQYIDDTGFNWGLTVRKKSERIMKLLEKGTLLKEERKNARRLSRGIEGFGSFSHRSTPAQGVLREKSLPTTLKRYDSDLNNHEDQENHSSCSNNVVNVDTVAVKSPSHQGETFKSLGSVEAKEYQDDDLGNNQMLPKSETSSKENMEPSKEEFHLWNLNGESKALLDCGEEDSKLGIIRTEDDHPFSSAEMHATASLLSAC

SEQ ID NO: 10549 - protein, 363 aa, Candida milleri
MSTTKTIVVLPGDHVGTEITEEATKVLNAIAEKRPNIKFDFQHHLIGGAAIDATGVPLPDEALEASKKADAVLLGAVGGPKWGTGDVRPEQGLLKIRKELGLYANLRPCNFAFDSLLDMSPLKPEYARGTDFTVVRELVCGIYFGKRKEDTGDGVTWDSEQYSVPEVQRITRMAASLALQHNPPLPIWSLDKANVLASSRLWRKTVEETIKNEFPTLSVQHQLIDSAAMILVKNPTKLNGLVITSNMFGDIISDEASVIPGSLGLLPSASLASPPDTNKAFGLYEPCHGSAPDLPKGKVNPVATILSVAMMLKLSLDMVEEGIAVEKAVRKVIDNGIRTADLRGTNSTTEVGDAIAAAVKEFL

SEQ ID NO: 10550 - protein, 385 aa, Nostoc punctiforme
MTKIMLPFIRSDLAQFTAYKPHPSSDTADSVSTQFDRLDTNESPYDLPPELKEKLAWTYQQVIETNRYPDGGHETLKDAIAEYVNESAAFPLSNTAANISVGNGSDELIRSLLIATCLGREGSILVANPTFSMYGILAQTLGIPVVTVGRDETNFEIDLKAAQSAIEQTQNPPIRVVFVVHPNSPTANSLTTAELAWLRSLSEHILVVIDEAYFEFSQTTLVGELAQRPNWVILRTFSKAFRLASLRVGYCVAHPEAIAILEKVRLPYNLPSFSIAAALVALQNRTLLLESIPQTLSERSKLIEILSQQPELQITASAANFIYLRLKPNGLNSQDAVLKTFHQKLRKLGTLVRHISGGLRITVGTIEENARTITRVQAAIADLEF

SEQ ID NO: 10551 - protein, 506 aa, Oryza sativa (japonica cultivar-group)
MESPLSHPAMVALSLLLLVALYLARRAVLGKKRRYPPVAGTMFHQLLNFGRLLEYHTELSRKYRTFRMLTPTCNYVYTVEPANVEHILKTNFANYGKGPMTHDVLEDLLGDGIFNVDGGMWRQQRKVASLEFSTRVLRDYSSAVFRDTAAELAGILERGPAAKGRERVDMQDLLMRATLDSFFRVGFGVNLGVLSGSSKEGLVFARAFDDASEQVLFRFFDLLWKVKRFLNISSEATMKQSIRTINDFVYSIIDRKIEQMSREQHEFAKKEDILSRFLLEREKDPGCFDNKYIRDIILNFVIAGRDTTAGTLSWFLYAVCKNQRVQDKIAREVRDATTGDRDVGVQDFSSFLTEDAINKMQYLHAALTETLRLYPGVPLDVKYCFSDDTLPDGHAVKKGDMVNYQPYPMGRMKFLWGDNAEEFKPERWLDDSGMFVAESPFKFTAFQAGPRICLGKEFAYRQMKIVSAVLLYFFRFEMWDDDATVGYRPMLTLKMDGPFYLRALAR

SEQ ID NO: 10552 - protein, 469 aa, Salmonella typhimurium LT2
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLLIGKKRMAGMR

SEQ ID NO: 10553 - protein, 199 aa, Arabidopsis lyrata subsp. petraea
SPSFSIHSSEANLRKSRALRKPFCSIRNRVYCVQSSSVSVDESKNITMGDSFIRPHLRQLAAYQPILPFEVLSAQLGRKPEDIVKLDANENPFGPPPEATLGNMKFPYVYPDPQSRRLRDALALDSGLESEYILVGCGADELIDLIMRCVLDPGEKIIDCPPTFSMYVFDAAVNGAGVIKVPRNPDFSLNVDRIAEVVE

SEQ ID NO: 10554 - protein, 413 aa, Arabidopsis thaliana
MGLEEQGRAREDTPLLGKGRPLSSKFKTFANVFIAIVGAGVLGLPYAFKRTGWLMGLLTLFSVAALINHCMMLLVHIRRKLGVSNIGSFGDLGFAACGNLGRFVVDILIILSQAGFCVGYLIFIGNTLANLSKPTKSTTLMSLRHLMGVSPKSLYIWGCFPFQLGLNSIKTLTHLAPLSIFADVVDLGAMAVVIVEDIKITVVQRPQVVAFGGMSVFFYGMGVAVYAFEGVGMVLPLESETKDKDKFGKVLALSMLFIAVMYGSFGVLGYMAFGDDTMDIITANLGAGVVSSLVQLGLCINLFFTFPLMMNPVFEIVERRFWSGMYCVWLRWLLVLAVTLVALLVPNFADFLSLVGSSVCCALGFVLPSLFHLMVFKDEMEWKQRALDVGILLLGVILGVSGTWSSLTEIFQE

SEQ ID NO: 10555 - protein, 148 aa, Zea mays
MEVAGACCHAGEERKVAVPIGNDAEVEPCVIAVDDSSVDRAIVTALLRRSKYRVTAVDSGKRALEILGSEPNVSMIITDYWMPEMTGYDLLKKVKESSKLKRIPVVIMSSENVPTRITRCLEEGAEDFLLKPVRPSDISRITTRMLLH

SEQ ID NO: 10556 - protein, 146 aa, Tamarix androssowii
MTIGSGGSSVVVPRNFRLLEELERGEKGIGDGSVSYGMDDGDDIYMRSWTGTIIGPHNTVHEGRIYQLKLFCDKDYPEKPPSVRFHTRVNMTCVNPETGVVEPKKFGMLSNWMRDFTMEDILTQLRKEMATPQNRKLVQPPEGTCF

SEQ ID NO: 10557 - protein, 134 aa, Vibrio vulnificus
MRSTGLADTVLVGPEPEFFLFDDVKFATDMSGSFFKIDDVEAAWNTGSDYENGNKGHRPGVKGGYFPVAPVDSSQDLGSAMCLVMEEMGLVVEAHHHEVATAGQNEIATRFNTLTTKADEIQIYKYVVHNVAHA

SEQ ID NO: 10558 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 10559 - protein, 175 aa, Picea mariana
ELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 10560 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 10561 - protein, 434 aa, Oryza sativa (japonica cultivar-group)
MEAQWLAEYPHQGADKRPRKRPRLAWDVAPPLFQPPKAIPMLYCGQELINGNFATAFLPPPPIYYTGPPRNLSPPWRPDDKDGHYVFAVGENLTPRYRILSKMGEGTFGQVLECWDLEHQETVAIKIVRSLQKYREAAMIEIDVLQRLGKHDFTGSRCVQIRNWFDYRNHICIVFERLGPSLYDFLRKNSYRAFPIDLVREFARQILESVAFMHDLRLIHTDLKPENILLVSSESIRVPDYKVTIRPPKDGSFFKNLPKSSAIKLIDFGSTTFEHQDHNYVVSTRHYRAPEVILGLGWNYSCDLWSVGCILVELCSGEALFQTHENLEHLAMMERVLGPLPKHMIVRADRRAEKYFRRGLRLDWPEGAASRESLKAVWKLPRLQNLVMQHVDHSAGDLIDLLQGLLRYDPDARLKAREALQHPFFTRCHRRCGY

SEQ ID NO: 10562 - protein, 144 aa, Triticum aestivum
  unsure (1)..(144): unsure at all Xaa locations
YDFLWVAEXGMKMKCYNGSQLWDTALTVQAIFATGLTKEFGHTIKVAHDYIKHSQIRADCPGDQSKWGRHLSKGGWTHSTADQRWPVSDCTAEAFKVLLLLTKVPELVDEPIETSTLDDAVNILLSLMNDDGSFGAYELTISYE

SEQ ID NO: 10563 - protein, 427 aa, Batrachospermum helminthosum
  unsure (1)..(427): unsure at all Xaa locations
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTADXV

SEQ ID NO: 10564 - protein, 355 aa, Thermosynechococcus elongatus BP-1
MHPPRHGGNLAWAAAIARCTPNEILDFSASLNPWGPPKSVIAALQASLATIRDYPDPDCRPLVEALTTLHRLPKDYFLVGNGAAELLTWVGRECGQRQRVFVVVPAFADYRRAVAAFDSTVVPLPLPQVQNNFSEVLPKLTPADAIIVNNPHNPSGHLWSRHHLQPLLETGALVVLDEAFMDFLPPAANESLIAAVPEYPNLIVVRSLTKFYGLAGLRLGYAVSSPERWQRWRAWRDPWSVNNLAIIAGVTALGDRPFQEHTWQWLPPTRQAFAAALNTLPELKVVTKSKANFLLIQASGSILSVQTYLLQQHRILIRDCCSFPELGASYFRVAVRRDSENQRLLEALRAYYQRP

SEQ ID NO: 10565 - protein, 469 aa, Rhodospirillum rubrum
MSDVKTILEMIKENDVKFVDFRFTDPKGKWQHTAQYVTTIDEESLVEGIMFDGSSIAGWKDINESDMILKPDLKSAFMDPFSAQPQLVLFCDVLEPSTGQPYERCPRSIAKKALSYLASTGIGDTSYFGPEAEFFVFDDVRFDVSMNRVMYEVDSEEGPYVTGKIFDEGNYGHRPPIKGGYFPVPPVDSAQDLRAEMLSTMAEIGMPVEKHHHEVAPSQHELGVRFNTLIEAADDMQKYKYVVHMVAHAYGKTATFMPKPIAGDNGSGMHVHQSIWKDGKPLFAGSGYADLSEMALYYIGGIIKHAKALNAFTNPSTNSYKRLIPGFEAPVLLAYSARNRSASCRIPYVASPKGKRVEVRFPDAAANPYLAFAAMMMAGIDGIENKIHPGDPMDKNLYDLPPEELMGIPTVCGSLREALDSLNADRDFLKKGGVFTDDMIDGYVALKWEEVYNLEHAPHPIEYKMYYSV

SEQ ID NO: 10566 - protein, 213 aa, Desulfitobacterium hafniense
MEFLLDSANPEEIRQAWAMGVIGGITTNPSLVAKEGRDFHQLLQELVQIVNGPISAEVIALDTEGMLGEARELAAMHPNIVVKIPMTEEGLKAVKVLKAEGIKTNVTLVFSAVQALLAARAGATYVSPFLGRLDDIGENGLLLLADICEVFGVHGLETKVIAASIRNPVHVTEAAKIGADYATVPFNVLCQLFKHPLTEAGIKKFLADWQKLK

SEQ ID NO: 10567 - protein, 437 aa, Desulfitobacterium hafniense
MEGFKIKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 10568 - protein, 178 aa, Glycine max
  unsure (1)..(178): unsure at all Xaa locations
IIKDIKESKESTHVHYEVVLWTHNTXRYINLIVGLNYTMENLFSSLYKNEAEISPYTLYAIACVMEKVPFINGSCXSILLPRLIDLAIMRNSXIVGYDFKSGQTKMKSVMMDTLAGACIKPSSIVTCIHLSNIYGMILSSPHTYRYNEIYMSNDADHIVNSTSILYDPRVHPYHVAVI

SEQ ID NO: 10569 - protein, 203 aa, Tradescantia virginiana
  unsure (1)..(203): unsure at all Xaa locations
LCDAEVGVIIFSNRGKLYEFCSGPSMMKTLERYEKSCFAGPDQNTQVKENQLVHSSRQEYLKLKARLDTLQRSQRNLLGEDLGSLSVKELDYLEKQLEMSLTEVRSTRTQQMLDQLTDLQRRESQLCDANKFLRKRLEELYQANGEQVWQIVPICHLTRHKTLRHVFFHPLECPPPTLQIGYDQSEQMPGPSVSNFMPXWMLC

SEQ ID NO: 10570 - protein, 606 aa, Prevotella intermedia
MQAIILAAGMGRRLGEYTKNNTKCMLPINGERLIDRTLTQLSTLNINRVIVVVGYGADNLIKYIGNRYNRFLKIEFIHNPIYDKTNNIYSLALAKEKMKEDDTLLLESDLIYEESILRMAIESSYPNLALVAKWESWMDGTVVQIDNEYNIINFINSQAFSFRDVNSYYKTVNIYKFSKEFVTRKYIPFLNAYCEAQGNNEYYEQVLRVIAFLNSQDVKALPIGNKRWYEIDDIQDKDIAETIFANDEKQLTKMNKRYGGYWRFPKLLDFCYLVNPYFPPKRMLDEIRANFDTLVTEYPSGMGVNSLLAGKYFGVNQEYIVVGNGAAELIKSLIETTKGKIGVVFPTFEEYPNRYRKGDIISYVPDNKDYSYNALNLKNFFADKSIQTLLLINPDNPSGNFIPKYEVLELAAWTAKRNIRLIVDESFVDFSDDYYYNSLLNNQTLEKYKHLFVMKSISKSYGVPGLRLGILASADTEVINFIKKDVSIWNINSFAEFYMQIFNKYRSDYNIACESLVAERNRFAKLLKEISWLRVIPSQANYFLCEVKPPYTSTEVAKRLLKDYAILIKDCNKKQSLTDMNYIRIAIRNEIENNRLVAACKKLEKF

SEQ ID NO: 10571 - protein, 605 aa, Mucor racemosus
MADFTDSLIKNIGVHSSSPVMTSVNMGQLGEKLRQARTTTLASLSQALSKKPEAAAAAATAPNAVNESTTTPTTMQLPASEKATSQLEINVVEARNLTIADARKADTYCIVHYEGNTTSTLDKVDDGILPSTPLVIKSQVASGAFKAFEIMMSASSPKWMHRVNFDVTAGNKEITVFVYDRGNKLPNGEDRFLGMSSIVPNLVNKKTVELIFPLHGRPDDDQEVTGDVRLQVTFIDPKKANLKPEDFRIVRMIGQGSVGKVYEVIKRDSGRTYAMKVLSKRLLLAENEVDTAFNERNVLVQSLSSPFIANLKYSFQTTNHLFLVMDYFPGGELFDFLERERCLSEKRCQFFAAEIVCAFDNIHARNIVYRNLKPESILLDAHGHIALTDFGLCKQLKNKMDLIQGVPQVITQEYLAPEMVMQKPYGMAADWWSLGVLMFELLTGSPPFHSVEQGELFRQILEAPIKFPAGGCITEEAKDFICQLLERDPAKRLGSHGDVAQVKAHPFFKDLNWDVVYKKQMQLPFVPEVEEQLREEAIAAAAAISIPVTNSKTESTNANVMPVADQSKFKGFSYIREDVMAKKGEHRLGVNPEDEDPEVDFWFRQ

SEQ ID NO: 10572 - protein, 221 aa, Oryza sativa
MADVFEGYERQYCEISASLARKCTAASALQGEKLKQKASEIKSGIDGAEALIKKMDLEARNQQPSVRAGLLAKLREYKSDLNNLKGTLKRVTTGNAQQGSREELLESGMAETLGVSADQKSRLLRITEKHNKTTDRIRDSHRTMLETEDLGVSLLQDLHQQRERLIHAHGTLDNVDDNIGKSRRIMGAMVRRMDRNKWIIGFIIALLVLVILVILYFKFVH

SEQ ID NO: 10573 - protein, 1187 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTTKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEPIKDAYA

SEQ ID NO: 10574 - protein, 313 aa, Xanthomonas axonopodis pv. citri str. 306
MELGMVGLGRMGANMAERLVNGGHRVHGYDPGANARTSAQAKGIVTADALAALVSALPSPRVVWLMVPAGKIVDDTLAQLLPLLQAGDIVIDGGNSYYKDSQRRAALLQASGIAFVDCGTSGGIWGLQEGYSLMVGGDEAAVTGLHPILATLAPAPDKGWGRVGPSGAGHFTKMVHNGIEYGMMQAYAEGFALMQHKADFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTSAAPTIGSKDA

SEQ ID NO: 10575 - protein, 326 aa, Methanosarcina acetivorans C2A
MQNRKVQNRKVQNRKVQNRNKAVKPVNDMKALTFGEALFDIIKGTVHLGGAPLNLAAHLAKLGAKPAVLTAVGKDELGKTLLSRAEEMGVDTSYILLDEKRPTGTVTVELQAEGIPIFTINEGVAWDAITPDEREFEALAAEEWDVFCFGTLAQRSEENRKTLKRLLSEIKAKHFFYDVNLRAGFYRKEWILSSLERCTILKMNEEEAAKISGMLFGTTYACRTLCRLLTDRYPKISVICITKGPEGAAVYQDGVYEEIKTTPVEVADTVGAGDAFSAGFLYTFLSGYGVSKAVSVAIMLGTYVASKPGSVPEYSEELRKELGILE

SEQ ID NO: 10576 - protein, 117 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 10577 - protein, 323 aa, Glycine max; identical to SEQ ID NO: 5177

SEQ ID NO: 10578 - protein, 490 aa, Ipomoea batatas
LNNNVLLSQSRKSLRLDGNKRKIKPGVAFSVLTRENGTETLTVEAPILERRRANPKNVAAIILPGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKHVVITNKDGVQESDRPDEGFYIRSGITIIMEKATIRYGTVI

SEQ ID NO: 10579 - protein, 590 aa, Porphyra purpurea
MLSKQIIGSEKTGRFALLDSIVRHGVIHIFGYPGGAILPIYDELYAWEELSLIKNILVRHEQGASHAADAYSRSTGKVGVCFATSGPGATNLVSGIATAHIDSVPILAITGQVGRPFIGTDAFQEVDIFGITLPIVKHSYVVRDPRDMSRIVAEAFYICKHGRPGPVLIDVPKDVGLEKFNYFSVEPGQVKIPGCRPLSNLKSRQILMAAKMIQQSSQPLLYIGGGAIISDAHSIIKELVDLYKIPVTTTLMGKGIFNEDSEFCLGMLGMHGTAYANFAVSECDLLIALGARFDDRVTGKLDEFACNAQVIHVDIDPAEVGKNRIPQVAIVGDVTEVVTSLLNLLKNNFKPYPEQIISWQERIHRWRQQYPLLVPKKSTSISPQEILVTTNQLAQDAYFTTDVGQHQMWSAQFLKVKSKHWISSAGLGTMGYGLPAAIGAQVAHPNELVICVSGDSSFQMNMQELGTIAQYKLPIKIVIINNRWQGMVRQWQQAFYGERYSHSRMTEGAPNFQKLAEAFGIKAFTVNNRQNMESSLKDAMKYPGPVLLDCQVTENENCYPMVAPGKSNAQMIGIAKPQRGTASNYVSRNI

SEQ ID NO: 10580 - protein, 133 aa, Oryza sativa
  unsure (1)..(133): unsure at all Xaa locations
QGYLDEQFCQVEDLQDEANPNFAEXVVSLFFKXSARVMLNFEQAIEKHPKDFARWDTHMQQLKGSCSSIGASRVKNECTSFRNFCGEENAEGCTRSFQKVKREHAVLRQKWESYFQLLRQAGPAGTATRPAGK

SEQ ID NO: 10581 - protein, 405 aa, Porphyridium aerugineum
VVWTDLLTACDLYRAKAYRVDPVPSSPDQYFAYIAYDIDLFEEASIANLTASIIGNVFGFKAVKALRLEDMRIPVAYLKTFQGPATGVIVERERMNNFGRPLLGATVKPKLGLSGKNYGRVVYEGLKGGLDFLKDDENINSQPFMRWRERFLFCMEGVNRAAASSGEVKGHYLNVTAGTMEDMYERAEFSKAVGSIICMIDLVIGYTAIQSMAKWARKNDMILHLHRAGNSTYSRQKNHGMNFRVICKWMRMAGVDHIHAGTVVGKLEGDPLMIKGFYNTLLESHLNINLPQGLFFEQNWASLRKVMPVASGGIHCGQMHQLIDYLGDDVVLQFGGGTIGHPDGIQAGATANRVALESMLLARNEGRDYLAQGPQILRDAAKTCGPLQTALDLWKDITFNYTSTD

SEQ ID NO: 10582 - protein, 336 aa, Archaeoglobus fulgidus DSM 4304
MKINLEELKFGTELIKRGFAKMQKGGVIMDVTNAEQAAIAEEAGAVAVMALHKVPADIRAAGGVARMADPKKIQEIIDAVTIPVMAKCRIGHIAEARALEALGVDMIDESEVLTPADVFFHIDKRKFVVPFVCGARSLGEAVRRIWEGAAMIRTKGEAGTGNVVEAVKHMRLINRAIFELQKMNEERIYGVAEKYASRYAELASRVREEMGLESVSRNDVVFEEYTLGEIIDGIYEILLEIRELGRLPVVNFAAGGVATPADAALMMQLGADGVFVGSGIFKSSNPPEYAKAIVEAVQHYDEPEVVAEVSKGLGEAMKGLDVFKLSEDERLQTRGL

SEQ ID NO: 10583 - protein, 217 aa, Clostridium tetani E88
MVKIAPSILSADFANLGRDIEAIEKYGAHVVHFDVMDGKYVPNISFGVPIMKSIKGLTKLPFDVHLMIEEPSKYIEDFAKAGADIITFHYEAETHLDRTINYIKSFGVKAGIALNPGTPVSLIKDLIPSLDMVLIMSVNPGFGGQKYIYYASDKIRELKKLKDELNKDLIIEVDGGVGKDNIKDIANCGVDLVVAGSAVFKDGKIEENLKVLREALR

SEQ ID NO: 10584 - protein, 404 aa, Bacillus subtilis subsp. subtilis str. 168
MQMGDTVFMFFCALLVWLMTPGLALFYGGMVKSKNVLSTAMHSFSSIAIVSIVWVLFGYTLAFAPGNSIIGGLEWAGLKGVGFDPGDYSDTIPHSLFMMFQMTFAVLTTAIISGAFAERMRFGAFLLFSVLWASLVYTPVAHWVWGGGWIGQLGALDFAGGNVVHISSGVAGLVLAIVLGKRKDGTASSPHNLIYTFLGGALIWFGWFGFNVGSALTLDGVAMYAFINTNTAAAAGIAGWILVEWIINKKPTMLGAVSGAIAGLVAITPAAGFVTPFASIIIGIIGGAVCFWGVFSLKKKFGYDDALDAFGLHGIGGTWGGIATGLFATTSVNSAGADGLFYGDASLIWKQIVAIAATYVFVFIVTFVIIKIVSLFLPLRATEEEESLGLDLTMHGEKAYQDSM

SEQ ID NO: 10585 - protein, 407 aa, Bifidobacterium longum DJO10A
MTLLSVLDILLMIVGGAGMIYQGLCIVMSLFAKPVRFPDAPMTNRYAVLISARNEEKVIGNLIGSIRDQTYPSNLIDIWLVADNCTDNTADVVRSLGCHVVERHNLELVGKGYALTYLLGHMLDIGVADDYEAYFVFDADNKLDKHYFEEMNKAFCSGFKILTSYRNSVNLADNWVSSGSALWFIRESRFLSNSRMILGSSCHVGGTGFMFSREVMKRNKGWKFHLLTEDLEFTMDSILHGDRIGYCGTAILYDEQPVTFSQSWRQRLRWSKGFLQVFRYYGSALLKRAVRERDFSCIDFTLMLCPFTVLGAIRAVMGLLFAACGFVSWPSQLQSLADWSSGIIISVLGLMALAALTIIVERDQIGATNKELLAYVLSFPIYILSYVPISFQAIFAKAQWKPIAHKG

SEQ ID NO: 10586 - protein, 321 aa, Enterococcus faecalis V583
MKTILVLHTGGTISMSKVAGGSVAPNEKNPLMEQEALFSGKVHLVVEDIFNIPSPHMTLERMFQLKERIQKAYSEPIDGVVITHGTDTLEETAYFLDITLEKKIPIVLTGAMRSSNEIGSDGLYNFISAIWTACSDESYDKGVLVVMNDEIHTARYVTKTHTTNVATFRTPTFGPIGTIAKERAFFAKEVLPQEVCDVSSVKGNVHVVKAYAGMGERMFELLNTPETDGLVIEALGAGNLPPETLPALQKMLDNGIPVVLVSRCSNGIAEDIYDYAGGGVGLKKMGVVFARGLNGPKARIRLIVGLNSEKNPAELKEFLEQ

SEQ ID NO: 10587 - protein, 280 aa, Fusobacterium nucleatum subsp. nucleatum ATCC 25586
MDTRFNGGVIMDVTTKEQAIIAEEAGAVAVMALERIPADIRAAGGVSRMSDPKLIKEIMSAVKIPVMAKVRIGHFVEAEILQAIGIDFIDESEVLSPADSVHHVNKRDFSTPFVCGARNLGEALRRISEGAKMIRTKGEAGTGDVVQAVSHMRQIIKEINLVKALREDELYVMAKDLQVPYDLVKYVHDNGRLPVPNFSAGGVATPADAALMRRLGADGVFVGSGIFKSGDPKKRAKAIVEAVKNYNNPEIIAKVSEDLGEAMVGINENEIKIIMAERGV

SEQ ID NO: 10588 - protein, 511 aa, Oryza sativa
MGAERGGDSCYSPAAVMATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 10589 - protein, 496 aa, Zea mays; identical to SEQ ID NO: 8942

SEQ ID NO: 10590 - protein, 406 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNVCKLVGCKEMGEEVLKSVDSKVPV

SEQ ID NO: 10591 - protein, 136 aa, Salmonella enterica
MPKPMFGDTGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLVGINNKIHPGEA

SEQ ID NO: 10592 - protein, 467 aa, Mazzaella cobinae
  unsure (1)..(467): unsure at all Xaa locations
NGKMGXWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAAXXXXXXXXXXFAKQLGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGATANRVALESMVIARNEGRDYVAKGPQILQDAAKTCGTLQTALELWKDISFNYTSTEYAEFLKTPXANVK

SEQ ID NO: 10593 - protein, 127 aa, Zea mays
RRPGEGSVDVLQKYPVPKCSLWFMKFSCDFYSNQMAIGTNKGEIYVWEVQSSPPVLIDRLCNQECKSPTGRAAVSFDGSTILGAADDGAIWRWDEVDPAASSSKPDQSAAAAAGAGAGAGAGADADA

SEQ ID NO: 10594 - protein, 103 aa, Glycine max
MSASGGRGSQEEEKKPSDQGAHINLKVKGQDGNEVFFRIKRSTQLKKLMNAYCDRQSVDFNSIAFLFDGRRLRAEQTPDELEMEDGDEIDAMLHQTGGGHKFL

SEQ ID NO: 10595 - protein, 93 aa, Brassica rapa
LQLEETRGNLHHKQHNITYGSSGSHYNNNGSINHNAYNPSMETDFVPEQTAPDKTVSHPKTHKGKIEKLPEPLIQILSPMDREARVLRYREKK

SEQ ID NO: 10596 - protein, 138 aa, Oryza glaberrima
SDDKALKRHLLRKYTGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPAAAVYTARPDH

SEQ ID NO: 10597 - protein, 350 aa, Pseudomonas syringae pv. tomato str. DC3000
MYTAIGYAAQSATAPLAPMTFERRAPRADDVAIEILFCGVCHSDIHQARNEWGIAVYPLMPGHEIVGRVTATGANATKYKVGDLVGVGCMVDSCRECSACKSDLEQYCLEGPTMTYATPDRVDGSNTMGGYSNSIVVAEHFVVRVPEKLDPAAAAPILCAGITTYSPLKHYGVKAGDKVGILGMGGLGHMGIKFAKAMGAEVTLFTRSAAKAQEARRQGADHVIVSTDAEQMKAAAGHFDFLLDTIPVQHDLNPYLETLRFDGVHILVGLIEPIEPPVHAAHLVMSRRVLAGSLIGGIAETQEVLDFCAENGITCDIEMLDIRNINEAYERMLAGDVKYRFVIDMATLQA

SEQ ID NO: 10598 - protein, 470 aa, ASPERGILLUS NIDULANS FGSC A4
MKFRLKGSTVGLLSWLAVAAAQTYTDCNPLEQSCPADPALGGSANYDFTQGASDDFTEVMSPSYGSDGASFTVAKQGDAPLIQSDWYIMFGHVEFVIKAAPGVGIVSSAVLQSDDLDEIDWEWLGGNNEYVQTNYFGKGNTATYNRAATHANSGNHDSFHTYTIDWTSSHVVWQIDGNTVRVLTPDSAESNQYPQTPMMVKVGVWAGGDPNNNEGTIQWAGGETDYTAGPFTMYLKSIKVTDYSTGNSYTYSDNSGSWQSIISDGGKINGNSAAQSMTDIGTVPSITATADSGPIPFEGTHRETTSFSTPSIYPWVPRPSSDDDSDSSPSTNLPGDWHFAGSGKPQPPSRSSMSEHCPQFRFIPSSNFMLKRCLFTTQYMRPSMSASYHFWSGLYSPSDLEPTDESPRWVFPETDPAELSDATTDEFRRVSATSGQDRNGLTISAANRIFKISWVLGASCALLGSLLVSA

SEQ ID NO: 10599 - protein, 393 aa, Elaeis guineensis
MASMVAFRPEAFLCFSPPKTTRSTRSPRISMASTVGPSTKVEIPKKPFMPPREVHVQVTHSMPPQKIEIFKSLEDWAENNILVHLKPVEKCWQPQDFLPDPSSEGFHEEVKELRERSKEIPDGYYVCLVGDMITEEALPTYQTMLNTLDGVRDETGASLTSWAVWTRAWTAEENRHGDLLNKYLYLSGRVDMKQIEKTIQYLIGSGMDPRTENSPYLGFIYTSFQERATFISHGNTARHAKEHGDVKLAQICGTIASDEKRHETAYTKIVEKLFEIDPDGTVLSFADMMKKKISMPAHLMYDGQDDNLFEHFSAVAQRLGVDTAKDYADILEFLINRWKVGELTGFSGEGKRAQDFVCTLAPRIRRIEERAQERAKQAPRIPCSWIYGREVQL

SEQ ID NO: 10600 - protein, 403 aa, Corynebacterium glutamicum ATCC 13032
MAQQRSVDDYLSILIDSVAPLPPVKTLILGAHPLSHLAEDVVATIPIPKFTNSAVDGYAILKEDIHGSGPWTFLVGGDTPAGSAPASINNGKAIRVMTGGPVPSTNKDMIVVPVELTNAPVDHSLPTEITINELPGERNNIRHAGEHLKEGEIAVAAGTAFDAGTVSTVISVGHDTVKAHPCPRVAVITTGDELNQGNPWGIPNSNGPMLVAELKRVGIKDPQHFHSDDSETALRETLDKAAEVADVIITVGGISAGAFDVVKAVGTKTGGFEFFPIAMKPGKPQGHGQWGDAKVVCLPGNPVAAWVSFRLFVVPVIERLGGGKRLASISELPVVALRSNRALKAREGAVLAIPVAIDWEKRMANSQAHRSHMVGALAGSGGIALVTSSIAEDGLVDVVLGRM

SEQ ID NO: 10601 - protein, 209 aa, Streptococcus agalactiae NEM316
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQDPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 10602 - protein, 294 aa, Escherichia coli
MSLRTPDLLFTAIAPAIWGSTYIVTTQYLPNFSPMTVAMLRALPAGLLLVMIVRQIPTGIWWMRIFILGALNISLFWSLLFISVYRLPGGVAATVGAVQPLMVVFISAALLGSPIRLMAVLGAICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 10603 - protein, 317 aa, Pisum sativum
MENFPIVDMGKLNTEDRKSTMELIKDACENWGFFECVNHGISIEMMDTVEKLTKEHYKKCMEQRFKEMVATKGLECVQSEIDDLDWESTFFLRHLPVSSISEIPDLDDDYRKVMKEFALKLEELAEELLDLLCENLGLEKGYLKKAFYGSKGPNFGTKVSNYPPCPKPELIKGLRAHTDAGGIILLFQDDKVSGLQLLKDDQWIDVPPMRHSIVINLGDQLEVITNGKYKSVMHRVIAQTDGARMSIASFYNPGDDAVISPASTLLKENETSEVYPKFVFDDYMKLYMGLKFQAKEPRFEAMMKAMSSVKVGPVVSI

SEQ ID NO: 10604 - protein, 507 aa, Agrobacterium tumefaciens str. C58
METGMQTTAEAIKGKRLGLFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVIDYSGAMQDPFVIRLR

SEQ ID NO: 10605 - protein, 126 aa, Oryza sativa
  unsure (1)..(126): unsure at all Xaa locations
APAGPAQTRDREKAGXTSPTARXRSGQEEQPEXXXKGRGTNKIVXPHHTXXXPPXDPKDTKTPPNKLAVRKPTGGLSTTRGCTGPKSATEPPNGSTDPDSTVNQIEAPTKKKGNKEPPLVINSLHT

SEQ ID NO: 10606 - protein, 124 aa, Glycine max
  unsure (1)..(124): unsure at all Xaa locations
FFQVGKNYLCTEWKQELITFSEFLQRIKSDSCSPGGPTYLAQHPLFDQINELRKDIXIPDYCFTGGGELRSLNAWXGPXGTVTPLHHDPHHNILAQVVGKKYIMLYSSSLSEELFPHSGTMLHN

SEQ ID NO: 10607 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 10608 - protein, 337 aa, Coccidioides immitis
MVVKVGINGFGRIGRIVFRNAVEHPEVEIVAVNDPFIETHYAAYMLKYDSTHGRFKGDVKFSENGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRTAAQNIIPSSTGAAKAVGKVIPSLNGKLTGMSMRVPTSNVSVVDLTCRTDKSVTYDQIKEAMKKASANELKGIMSYSEDALVSSDLNGDPHSCIFDATAGIALNDHFIKLVAWYDNEWGYSRRVIDLIAYIAGVDAGK

SEQ ID NO: 10609 - protein, 412 aa, Zea mays
MAAMPGGAHAAGAADQMQVDQPLPPAAAGTAHAPADAKHAGSMIEGSDPVTGHIISTTIGGKNGEPKKTISYMAERVVGTGSFGIVFQAKCLETGETVAIKKVLQDKRYKNRELQIMRSMDHCNAVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTAGP

SEQ ID NO: 10610 - protein, 282 aa, Escherichia coli
ALLLKTQLPSGSELSLYDIAPVTPGVAVDLSHIPTAVKIKGFSGEDATPALEGADVVLISAGVRRKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 10611 - protein, 489 aa, Microbulbifer degradans 2-40
MAAGWGDNMKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 10612 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 10613 - protein, 481 aa, Myrionema balticum
NRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATST

SEQ ID NO: 10614 - protein, 196 aa, Oryza sativa
MDLAAVHAALAGKSYSSVAPLCDDLFLQAASRGAATDGWPYAVHLLAHLYLNDLNSARFLWKSTPQEAKDARPELAAVWRIGQCLWNRDYAGVYAAAQGFEWSPEIADFVAAFLESYRKRIFQLLTSAYSTISVADAAPDPGTKEAEATNQAQPNGWSLDAAARMLTVVKPKVKTNQKLDASKLQRLTECVFHLEH

SEQ ID NO: 10615 - protein, 429 aa, Gonyaulax polyedra
MARGSFLAPLCLAAVVLGVWQLLPISFVAPSPRLRGVTSESAQVATAAPLERSHGSQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVFCASCTTNGLAPAVKAVNDALGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVDLIKHMAKVDAAAA

SEQ ID NO: 10616 - protein, 513 aa, Nitrobacter sp. KB212
  unsure (1)..(513): unsure at all Xaa locations
MDIRAQVSMVFHLDKCIGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLITAPLADEQPTARAISMVTGKYMDTIEAGPNWDDDLGGSQVYANNDPNFDGASDEEMRQINEINSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPXIIAAARANGIPDSKIEAAXKSPVFQFVKKWGIALPLHPEFRTLPMLFYVPPLGPVLAKVENGVYDNVANEARLGPLMSSLERSRIPLRYMASLLSGGNEEIIRDVYKKLVAVRVYMRSRKVKDIPDEEVQRALSEGKTTAAEVVAIWRLTSMPTFEERFVVPPMERETAVDALFPQLDPVSHNYPIRKGEVGVGFHTDPARGP

SEQ ID NO: 10617 - protein, 460 aa, Acrosorium decumbens
WDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATQEDMYERAEFAKQLGTVIIMIDLVIGYTSIQTMAIWARRNDMILHLHRAGNSTYSRQKIHGMNFRVICKWMRMAGVDHIHAGTVVGKLEGDPLMIKGFYDTLLLPYLDVNLPLGIFFTQDWASLRKVTPVASGGIHCGQMHQLLDYLGNDVVLQFGGGTIGHPDGIQAGATANRVALESMVIARNEGVDYVKEGPQILRDAAKTCGPLQTALDLWKDITFNYTSTDTADFVETPTANV

SEQ ID NO: 10618 - protein, 296 aa, Streptomyces rishiriensis
MRGILLAGGTGSRLWPVTRAVSKQLIPVFDKPMIYYPLTTLMMAGIREILVITRPEDQRQFRHLLGDGSQLGLCLEYAVQEKPEGIAQAFVLGADFIGDQSVALVLGDNIFHGAGLGTRLRQYSDPAGGRIFAYVVADPRAYAVVEFDEAGTAVSIEEKPASPKSRYAVPGLYFYDNRVLEVARDLMPSQRGELEITAVNETYLKWGQLRVTTLDRGAAWLDTGTFTSLVQASEYVRVVEERQGLKIGCVEEVAWRCGLIGNDQLRELSRPLLKSGYGRYLLDLLADQELKELKSS

SEQ ID NO: 10619 - protein, 360 aa, Bradyrhizobium japonicum USDA 110
MSMKFDIQPASNPTPEKDRVAKLVDPGFGRVFTDHMAIVRYNQAKGGWYEARIEARANFQLDPAGAVLHYAQEIFEGLKAYKRDDGGVNLFRPDANARRFRDSADRMAMAQLPEDVFIEAVEQVVRIDRAWMPGGEGSLYLRPFMIASETFLGVKPSSEYIFAVIASPVGSYFKGGPAPVSIWVSENYTRAAVGGTGAVKCGGNYAASLRAQAEAIQHGCDQVVFLDAIERRYVEELGGMNIFFVFEDGSLSTPPLGTILPGITRDSIIALAKDAGKTVREEPYSLDQWRKDAASGKLKEAFACGTAAVISPIGKVRSVSGDFEISGGVAGPVAMGLRKQLVDIQYGRTNDPHNWIRKVF

SEQ ID NO: 10620 - protein, 810 aa, Saccharomyces cerevisiae
MNTPQISLYEPGTILTVGSHHAKIIKYLTSGGFAQVYTAEISPPDPYSNANIACLKRVIVPHKQGLNTLRAEVDAMKLLRNNKHVVSYIDSHAARSVNGIAYEVFVLMEFCERGGLIDFMNTRLQNRLQESEILEIMSQTVQGITAMHALQPPLIHRDIKIENVLISHDGLYKVCDFGSVSGVIRPPRNTQEFNYVQHDILTNTTAQYRSPEMIDLYRGLPIDEKSDIWALGVFLYKICYYTTPFEKSGEAGILHARYQYPSFPQYSDRLKNLIRLMLMEAPSQRPNICQVLEEVSRLQNKPCPIRNFYLLRAMNQNANTQLAGEPSSTTYVPTQKFIPVQSLQSINQPPNMMPVTHVSTTPNLGTFPISINDNNKTEVTAHAGLQVGSHSNLTSPLMKTKSVPLSDEFASLYYKELHPFQKSQTFKSVESFQSPQRKSMPPLSLTPVNNDIFDRVSAINRPNNYVDSETQTIDNMAVPNLKLSPTITSKSLSSTKEIAAPDNINGSKIVRSLSSKLKKVITGESRGNSPIKSRQNTGDSIRSAFGKLRHGFTGNSVNNSRSASFDNNNVNGNGNNTNRRLVSSSTSSFPKFNSDTKRKEESDKNQRLEKRRSMPPSILSDFDQHERNNSRTGSRDYYRSHSPVKKTQASAKTTSKPTLIPDNGNVNINQEKKESIQRRVHNLLKSSDDPVTYKSASGYGKYTDIGTETSNRHSSVRITPITEEKFKKTLKDGVLDIKTKSNGKDKSRPPRPPPKPLHLRTEIQKIRNFSRLQSKKLPIERISSEATETIVDVNVDDLEADFRKRFPSKV

SEQ ID NO: 10621 - protein, 503 aa, Acinetobacter sp. M-1
MHYVDPNQSGSKIHFKDQYENFIGGQWVAPVKGVYFDNISPVDGKSFTRIPRSSAEDIELALDAAHKAKKEWNKSSPTTRSNLLLKIADRMEANLEMLAVAETWDNGKPVRETLAADIPLAIDHFRYFAGCIRAQEGGISEIDEDTIAYHFHEPLGVVGQIIPWNFPILMAAWKLAPALAAGNCVVIKPAEQTPVGILLVAELIQDLLPAGVLNIVNGYGAEVGRPLATSPRIAKIAFTGSTQVGQLIMQYATENIIPVTLELGGKSPNVFFADVMDHDDDFLDKTLEGFAMFALNQGEVCTCPSRALIQESIADQFMEKAIERVKRIKLGHPLDTDTMVGAQASLEQQEKILRCIDTGRQEGAEVLLGGHGRQEVGNGYYIEPTIFKGHNNMQVFQEEIFGPVLSVTTFKDFDEAIQIANDTMYGLGAGVWSRSTHTAYRAGRAIEAGRVWTNCYHIYPAHAAFGGYKKSGVGRENHKMMLDHYQQTKNLLVSYSTKAMGFF

SEQ ID NO: 10622 - protein, 170 aa, Oryza sativa
MGGRKDNHDSSNADKGFHGAYPSGYYPNSPGQYPTPGGYPSAPPGQYPPAGGYPGAQYPPSGYPPSQGGYPPGAYPPSGYPQQPGYPPAGYPGHGRGGMLGGGHGAGASGYGALLAGGAAVAAAAVGAHMVRPGGGGGHGMFGHHGGKFKKGKFKHGKYGKHKKFGRKWK

SEQ ID NO: 10623 - protein, 648 aa, Xanthium sp.
MAAIPHTNPSITTKPPSSPPRPTFLARFTFPITSTSHKRHRLHISNVLSDSKPTITHSPLPTKSFISRYAPDQPRKGADVLVEALEREGVTDVFAYPGGASMEIHQALTRSTTIRNVLPRHEQGGVFAAEGYARASGLPGVCIATSGPGATNLVSGLADALLDSVPMVAITGQVPRRMIGTDAFQETPIVEVTRSITKHNYLVLDVEDIPRIVREAFYLASSGRPGPVLIDVPKDIQQQLVVPKWDEPIRLPGYLSRFPKTENNGQLEQIVRLVSEAKRPVLYVGGGCLNSGDELRRFVELTGIPVASTLMGLGAYPASSDLSLHMLGMHGTVYANYAVDKSDLLLAFGVRFDDRVTGKLEAFASRAKIVHIDIDSAEIGKNKQPHVSICGDIKVALQGLNKILEVKNSVTNLDFSNWRKELDEQKVKYPLSFKTFGEAIPPQYAIQVLDELTGGNAIISTGVGQHQMWAAQFYKYNKPRQWLTSGGLGAMGFGLPAAIGAAVARPDAVVVDIDGDGSFIMNVQELATIRVENLPVKILLLNNQHLGMVVQWEDRFYKANRAHTYLGNPSKESEIFPNMLKFAEACDIPAARVTRKADLRAAIQKMLDTPGPYLLDVIVPHQEHVLPMIPAGGGFMDVITEGDGRMKY

SEQ ID NO: 10624 - protein, 411 aa, Medicago sativa
MATAGVAPASGIVDVNASSAIAVDKLPDEILGMRIKDDKEMEAHVVDGNSTEAGHVIVTTIGGKNGQPKQTISYMAERAVGQGSFGVVFQAKCLETGETVAIKKVLQDKRYKNRELQTMRLLDHPNVVTLKHCFFSTTEKDELYLNLVLEFVPETVHRVIRHYSKMNQRMPLIYVKLYSYQICRSLAYIHNCVGVSHRDIKPQNLLVNPHTHQLKLCDFGSAKVLVKGEPNISYICSRYYRAPELIFGATEYTSAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFFDELRDPNTRLPNGRHLPPLFNFKANELKGVPAEMLVKLVPSHARKQCSLFASS

SEQ ID NO: 10625 - protein, 144 aa, Saccharomyces cerevisiae [sequence omitted]

SEQ ID NO: 10626 - protein, 191 aa, Arabidopsis thaliana
MFAAENGLKGDPRLEAISAAIRVVPNFPKKGIMFQDITTLLLDHKAFKHTIDIFVDRYKDMQISVVAGVEARGFLFGPSIALAIGAKFIPLRKPGKLPGKVISESYELEYGHDRLEMHVGAVEPRERVIIIDDLVATGGTLSAAMSLLESQGAEVVECACVIGLPEVKGQHKLKGKPLYVLVEPSGLDEFC

SEQ ID NO: 10627 - protein, 294 aa, Triticum aestivum
MRMSLLRSASQHLRRRRDYSSASASPERKVAILGAAGGIGQPLALLMKLNPLVSSLSLYDIAATPGVAADVSHINTRALVKGFVGDDQLGEALEGADLVIIPAGVPRKPGMTRDDLFRINAGIVKGLCTAIARHCPNALVNMNSNPVNSTVPIAAEVFKKAGTYDEKKLFGVTTLDVVRAKTFYAGKANVPVTGVNVPVVGGHAGITILPLFSQATPASNALSHEDLLALTKRTQDGGTEVVEAKAGKGSATLSMAYAGAVFGDACLKGLNGVPDIVECSFVQSTVTELPFFAS

SEQ ID NO: 10628 - protein, 174 aa, Glycine max
MRSQLVCNGCRSILVYPRGATNFCCALCNTITSVPPPGMDMSQLYCGGCTTLLMYTRGATSVRCSCCHTINLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 10629 - protein, 417 aa, Yersinia pestis CO92
MESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 10630 - protein, 160 aa, Triticum aestivum
  unsure (1)..(160): unsure at all Xaa locations
RAEFGTSTVPLLPAPDFGIDVASILERISSPESTSIKIIFICSPGNPTGNLIKKDDIKQILEQPTWNGIIVVDEAYIDFAPEVTSLAEWVAEWPNLVVIQTLSKAFGLAGIRLGVAFASPPVAAILNKVXXPYNISSPTSAFAIMSLHPAGLEIMGNNXK

SEQ ID NO: 10631 - protein, 187 aa, Glyptostrobus lineatus
ICTYFAQPLHQRDYTRWPEKPEGWREIVDKYSEALMGLASKLLGIVSEALGLEPEAVTKACVEMDQKVVINYYPKCPQPDMTLGLKRHTDPGTITLLLQDQVGGLQATKDDGLNWITVEPVQGAFVVNLGDHMHFLSNGKFKTADHQAVVNSNYSRLSIATFQNPSQEAIVYPLKLEEGEQSFMEEP

SEQ ID NO: 10632 - protein, 307 aa, Helicobacter pylori J99
MLVKGNEILLKAHKEGYGVGAFNFVNFEMLNAIFEAGNEENSPLFIQASEGAIKYMGIDMAVGMVKIMCERYPHIPVALHLDHGTTFESCEKAVKAGFTSVMIDASHHAFEENLELTSKVVKMAHNAGVSVEAELGRLMGIEDNISVDEKDAVLVNPKEAERFVKESQVDYLAPAIGTSHGAFKFKGEPKLDFERLQEVKRLTNIPLVLHGASAIPDDVRKSYLDAGGDLKGSKGVPFEFLQESIKGGINKVNTDTDLRIAFIAEVRKVANEDKSQFDLRKFFSPAQLALKNVVKERMKLLGSANKI

SEQ ID NO: 10633 - protein, 798 aa, Burkholderia fungorum
MSVAEYFSSMEYGPAPESDQAARAWLAQHEARFGHFIGGAWREPGAGERFASHAPASGEPLAQIAHGDAGDIDAAVCAARAAQPAWLALGGAGRARHLYALARMVQRHSRLFAVLEALDNGKPIRETRDIDVPLVARHFLHHAGWAQLQESEFAAYAPLGVIGQIVPWNFPLLMLAWKIAPAIAMGNCVVLKPAEYTPLTALLFAELAHRAGLPAGVLNVVTGDGRTGAALVEHPQIDKIAFTGSTEVGKAIRAVTAGSGKSLTLELGGKSPFIVFDDADLDGAVEGVVDAIWFNQGQVCCAGSRLLVQEGIEARFIARLKRRMETLRIGSSLDKSIDIGAIVDPVQLERIRSLVETGRREGCAVWQSPGTVLPAQGCFYPPTLVTGVAPASTLAQQEIFGPVLVAMSFRTPDEAIALANNSRYGLAASVWSETIGRALDIAPRLACGVVWINATNLFDAAVGFGGYRESGYGREGGREGIYEYLKPRAWLNLGWRQPRNAETVADQPERSLNVMAIDRVDRTAKLFIGGKQVRPDSGYSLPVYAPDGTPVGEVGEGNRKDIRNAVEAARAAHKWSQASAHNRAQVLFYLAENLSVRADEFARQLMQRNGATEAVARAEVEASVTRLFTYAAWADKFDGAVHTPPLRGVALAMHEPLGVIGIACPDEAPLLGFVSLMAPALAMGNRVIVLPGQACPLAVTDFYQVAETSDVPGGVLNVITGERGALLPALARHNDVDALWCFGSAADSTLVERESAGNLKRTFTDYGRQFDWFDPSSEGLPFLREAVQVKNIWVPYGD

SEQ ID NO: 10634 - protein, 533 aa, Chlorella kessleri
MAGGGVVVVSGRGLSTGDYRGGLTVYVVMVAFMAACGGLLLGYDNGVTGGVVSLEAFEKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGLAAAPGAILFLGSLVLPESPNFLVEKGKTEKGREVLQKLRGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 10635 - protein, 311 aa, GIBBERELLA ZEAE PH-1
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGNLQGNFLASFALGWIVTTGAGIASYPLDTIRRRMMMTSGEAVKYKNTMDAARQIVAKEGVKSLFKGAGANILRGVAGAGVLSIYDQLQVLLFGKAFK

SEQ ID NO: 10636 - protein, 106 aa, Glycine max
MAIFKALLASILISLVIVNLVESDTMYQVIKNTVEGSSPSPSPPTIDCDVECNRRCQLSSRPNLCKRACGTCCQRCNCVPSGTYGHYEECSCYANMTTHGGKHKCP

SEQ ID NO: 10637 - protein, 575 aa, Lotus japonicus
MMFCAPHPENGCKNVKGFALQVLQGRWFMMLASFMIMAVSGASYMFSLYSREIKFALGYDQSTLNLLSFFKDVGSNIGILSGLINEVTPPWVVLSMGAVLNFFGFFMIWLAVAKKIANPRVWHLCLYIVIGSNSHCFTNTAVMVTSVKNFPGIRGIVLGILGGYLSLSAIIITQLYYAFFINDSQSMILIMACLPTATALILLPVIKNHKSIQQKNDSKVFYRFIYLVLALAGFLMIMIILQISFNFTQSEYYATTTVMLLLLTLPLAVVIVEDCKIWKSKQELINCENPPRPVDTTTKSNELKSEQTIPEGLSCWQNILRHPERGEDHTVLQAIFSLDMVILFFATVCGFGSNLTVYNNLSQIGKSLGYPSYTITTFVSLMSIWIFLGKIAQGVLSEFMITKLKLPRPLMFTIVHVLSCIGHLLIAFNVPNGLYAASIFIGFCLGASWPIINSLISELFGLKHYSTLYNVGTVASPIGSYLLNVKVAGYLYDREARRQMAALGLQRKPGEELNCNGSDCYKLAYIIITAVCLFGALVSFILVLRTRQFYKTDIYKKFTEEPRTAETKMVIPGKD

SEQ ID NO: 10638 - protein, 284 aa, Lycopersicon esculentum
MEGEVRRWWWWWTWRWLWWWERFWGRNARAGGGGAYAAGGHDGGYAGGGGSGSGAGGGHAGGGYAGGGGGGSGAGGAHAGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 10639 - protein, 591 aa, Streptococcus pneumoniae
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAISKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFTFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSIDVGNTTQTSTRHLHMTPKNMWRTSPLFATMGIALPGGIAAKKDNPDRQVWNIMGDGAFNMCYPDVITNVQYDLPVINLVFSNAEYGFIKNKYEDTNKHLFGVDFTNADYAKIAEAQGAVGFTVDRIEDIDAVVAEAVKLNKEGKTVVIDARITQHRPLPVEVLELDPKLHSEEAIKAFKEKYEAEELVPFRLFLEEEGLQSRAIK

SEQ ID NO: 10640 - protein, 632 aa, Triticum aestivum
  unsure (1)..(632): unsure at all Xaa locations
PPSSSVPLLSSAQPNQPGPILAQLQETYACSPATERGRGILLAADAKAETIAYCTGRSVITRRLDAPLVTRRLSAYADPPIVARFSSNGXWVATADASECARACGSGNDRALKAXEFRPITGRFLDLRXSSTAMRIDLSAGTAXGKSPVRAVRWGAGSTGGGVDGHSKRVYTCEVNPTRPFRVETCAEYFLPNYYLGPPFKFKHSIRDHTNFVNCIRYSPDGTKFITVSSDKKGLIYDGKTGDKIGELSSEGSHTGSIYAGCWCPVSILVRALSADKTAKVWDISEDXSGTLNRTLVCTGIGGVDDMLVGCLWQNDNLVTISLGGTFNVFSAINPDKEPVSFAGHLKTASALALFPQSNPRTMLSTSYDGVILKWIQGVGYGGRLIRKNNTQIKCFVATEEELITSGYDNKVFRIPVNGDQCGDAESTDVGGQPNALNIALQQPEFALVTTDSAIVLLNKSNVTSTTKVSYTITSSAVSPDGTEAIVGAQDGKLRIYSISGDTVTEEAVLEKHRGPITTIHYSPDVSMFCSADSNREAVAWDRATREVKLKNMLFHTARVNCLAWSPDSRFVATGSLDTCAIIYDVDKPAASRTTIKGAHLGGVHGISFADNDTLVTAGEDACIRVWKLTHQ

SEQ ID NO: 10641 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 10642 - protein, 638 aa, Avena fatua
MDFMKVFDQTVREIKREVNLKVLKVPELEQKVLDATSDEPWGPHGSALSDVAQATKKYSECQMVMGVLWARLAERDSNWRHVYKALTIIEYLIANGSERAVDNILDHFSKISVLSSFEFVEPNGKDAGINVRKKVETLVGIINDKDRIKAVRDKAASNRDKYVGLSSTGSSYRSSSATVGSNYSSGERYGSFGGTREGDSFSNSYKDKESAKTSAGSNGSKKSGSKTRKDAKHDRSSSKPPSTAKSNEDDFDDFDPRGSSSNDAANNAKTSEVDLFGPNLMDDFMDEPAATPATKGVVEPQVDLFGDADFQSATPSAETAAHQDVQDNVDLFAGNATFASAFPSQTGFIPPPSSGTSSSANSFVSKKTVPEPFDPFGDIPLSSFGGSDPFGDFSSNVGSSTAPPAVHNSTGNISTPSQNSQAASDFGAFESNTGGAAKDPFDFSSGGNFGKTNVTPLAAPKTDTSDFGAFVANTAERAKDPFDLSSSINNGRTGQTPLAAPKSNTKKENLQVKSSIWADSLSRGLIDLNITGPKKVNLADVGIVGGLGDGSDDKAHQPSWNMGGGGIWSRDVWNPSIYTRRRHRELGELQQVPVWLQMSVQARAFVVFWCSCCRAVKCILISFLLLYTSVLVISLCYL

SEQ ID NO: 10643 - protein, 758 aa, Panax ginseng
MWKLKIAEGGNPWLRTLNDHVGRQIWEFDPNIGSPEELAEVEKVRENFRNHRFEKKHSADLLMRIQFANENPGSVVLPQVKVNDGEDISEDKVTVTLKRAMSFYSTLQAHDGHWPGDYGGPMFLMPGLVITLSITGVLNVVLSKEHKREICRYLYNHQNRDGGWGLHIEGPSTMFGTVLNYVTLRLLGEGANDGQGAMEKGRQWILDHGSATAITSWGKMWLSVLGVFEWSGNNPLPPETWLLPYILPIHPGRMWCHRRMVYLPMSYLYGKRFVGPITPTVLSLRKEVFSVPYHEIDWNQARNLCAKEDLYYPHPLIQDILWASLDKVWEPIFMHWPAKKLREKSLRTVMEHIHYEDENTRYICIGPVNKVLNMLCCWVEDPNSEAFKLHLPRLHDFLWLAEDGMKMQGYNGSQLWDTAFAVQAIISTNLAEEYGPTLRKAHTFMKNSQVLDDCPGDLDAWYRHVSKGAWPFSTADHGWPISDCTAEGFKAVLQLSKLPSELVGEPLDAKRLYDAVNVILSLQNSDGGYATYELTRSYSWLELVNPAETFGDIVIDYPYVECTSAAIQALTAFKKLFPGHRREEIQHSIEKAALFIEKIQSSDGSWYGSWGVCFTYGTWFGIKGLVTAGRTFSSCASIRKACDFLLSKQVASGGWGESYLSCQNKVYTNLEGNRSHVVNTGWAMLALIDAGQAERDATPLHRAAKLLINSQMENGDFPQEEIMGVFDKNCMITYAAYRNIFPIWALGEYRCRVLQGPS

SEQ ID NO: 10644 - protein, 398 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTKVTSPSAKAKLRLLFEVAPLGFLIEKAGGYSSDGHQSVLDKVINNIDDRTQVAYGSKNEIIRFEETLYGKSRLKDGVAVGASAPCVRPAIQNKL

SEQ ID NO: 10645 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 10646 - protein, 221 aa, Oryza sativa (japonica cultivar-group)
MLSFQNDLMSLANFHNWEKFLCGYMRRDGHEDGERSQGIEDSLMFGPDDDNGSNIPTQVETLVRGTATVATPEYKSIPDLDYLQNDLIHLVVMQELLAIQQQGPRAIGFFGTRNMGFMHQQLIEILSYAMVITKNHIFTSGASGTNAAVIRGALRAEKPELLTVILPQSLKKQPPESQELLSKSSILLVCHRFGLTSGWLVIEYLVQLAVFTLKLRNDTAE

SEQ ID NO: 10647 - protein, 468 aa, Phyllariopsis brevipes
IPYAKMGHWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWERRFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVSEGPEILRNAASTFGPLKAALDLWKDITFDYTSTDTPDFVEVPTESN

SEQ ID NO: 10648 - protein, 195 aa, Sulfolobus solfataricus
MDLTLIIDNYDSFVYNIAQIVGELGSYPIVIRNDEISIKGIERIDPDRLIISPGPGTPEKREDIGVSLDVIKYLGKRTPILGVCLGHQAIGYAFGAKIRRARKVFHGKISNIILVNNSPLSLYYGIAKEFKATRYHSLVVDEVHRPLIVDAISAEDNEIMAIHHEEYPIYGVQFHPESVGTSLGYKILYNFLNRV

SEQ ID NO: 10649 - protein, 406 aa, Glycine max
MVGETAATGKSVGLGLGCDPVVGSLACSKKREYRVTNRLQEGKRPLYAVIFNFIDSRYFNVFATVGGNRVTVYQCLEGGVIAVLQSYVDEDKDESFYTVSWACNVDGTPFVVAGGINGVMRVIDVGSEKIHKSFVGHGDSVNEIRTQTLKPSLVISASKDESVRLWNVHTGICILIFAGAGGHRNEVLSVDFHPSDIYRIASCGMDNTVKIWSMKEFWTYVEKSFTWTDLPSKFPTKYVQFPVYNASVHLNYVDCNRWLGDFILSKSVDNEIILWEPKVNEQTPGEGVVDVLQKYPVPECDIWFIKFSCDFHFNIVTVGNREGKIFVWELQSSPPVLAAKLSHPQSKSPIRQTATSFDGSTILGCCEDGTIWRGDVSKPSTSILTRSLPYLRATPICCACHTQGHL

SEQ ID NO: 10650 - protein, 364 aa, Glycine max
MATSENNNARPQRVAKKRAAAAICELHRNAAKRKRVVLGDLTNVSSNYVAVTEKEIQKQKKVKREQPARPVSTPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKFKCVATTPSPPEIPLSFFEFEGQILRQL

SEQ ID NO: 10651 - protein, 471 aa, Bacillus anthracis str. A2012
MSKLLKKKSVTQLLEHNQSKALTKTLGAFDLIMLGVGSIIGTGVLVLTGLVAARDAGPAVIFSFVLAAIICGFIALCYAEIASTLPASGSVYTYSYATIGEFVAHLVGWSLLLIYIVATAAVAAGWTGYFHNLIKGFGLEIPKALVTIPSHGGIVNLPAVIITLILAWMLSRGTRESKRINNIMVLIKIGMILLFITVGIFYVKPMNWIPIAPYGLSGVFTGGAAILFAFTGFDILATSAEEVKDPKRNLPIGIIASLIICTIIYVMVCLVMTGMVSYKELNVPEAMAYVMEVVGQGKVAGAIAVGAVIGLMAVIFSNMYAATRVFFAMSRDGLLPKSFAKVNKKTGAPTFITGLAGIGSSIIAGFIDLKELVNLVNIGSLVTFALVCLSVIILRKSHPNLKRGFMVPFVPVLPCVAIVCCVFLMLNLPLRTWVYFSIWITIGVVIYFLYSIKHSNLNEETISKLHDKIAR

SEQ ID NO: 10652 - protein, 500 aa, Brucella melitensis 16M
MPYCPIALHKETTMKAQPKASHFIGGAFVEDKAGKPLPVIYPATGEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 10653 - protein, 769 aa, Arabidopsis thaliana
MWKLKIANGNKEEPYLFSTNNFLGRQTWEFDPDAGTVEELAAVEEARRKFYDDRFRVKASSDLIWRMQFLKEKKFEQVIPPAKVEDANNITSEIATNALRKGVNFLSALQASDGHWPAENAGPLFFLPPLVFCLYVTGHLHEIFTQDHRREVLRYIYCHQNEDGGWGLHIEGNSTMFCTTLNYICMRILGEGPNGGPGNACKRARDWILDHGGATYIPSWGKTWLSILGVFDWSGSNPMPPEFWILPSFLPIHPAKMWCYCRLVYMPMSYLYGKRFVGPISPLILQLREEIYLQPYAKINWNRARHLCAKEDAYCPHPQIQDVIWNCLYIFTEPFLACWPFNKLLREKALGVAMKHIHYEDENSRYITIGCVEKALCMLACWVEDPNGIHFKKHLLRISDYLWIAEDGMKMQSFGSQLWDSGFALQALVASNLVNEIPDVLRRGYDFLKNSQVRENPSGDFTNMYRHISKGSWTFSDRDHGWQASDCTAESFKCCLLLSMIPPDIVGPKMDPEQLYEAVTILLSLQSKNGGVTAWEPARGQEWLELLNPTEVFADIVVEHEYNECTSSAIQALILFKQLYPNHRTEEINTSIKKAVQYIESIQMLDGSWYGSWGVCFTYSTWFGLGGLAAAGKTYNNCLAMRKGVHFLLTTQKDNGGWGESYLSCPKKRYIPSEGERSNLVQTSWAMMGLLHAGQAERDPSPLHRAAKLLINSQLENGDFPQQEITGAFMKNCLLHYAAYRNIFPVWALAEYRRRVPLPYEKPSTERRS

SEQ ID NO: 10654 - protein, 275 aa, Glycine max
  unsure (1)..(275): unsure at all Xaa locations
PADMSKVLQVEIEAEQEKVEQLDTRRGNEFGLFTKQFLRRHGLHLVGTATTWFLLDIAYYSQNLFQKDIFSTIGWIPEXXXMNAVEEVFKIARAQTLIALCSTVPGYWFTVALIDKMGRFTIQLMGXXFMTVFMFALAIPYHHWTMKGNQIGFVVLYSLTFFFANFGPNATTFVVPAEIFPARLRSTCHGISAAAGKAGAMVGAFGYLYTQNAIGLRNTLIVLGVVNFLGLLFTFLVPESKGKSLEEMSGEAEEETTAATRESAMEPGLGVRSSV

SEQ ID NO: 10655 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 10656 - protein, 179 aa, Glycine max
GSSLFAGRMWCHSRLVYLPMSYLYGRRFVGPINTIILSLRKELYTIPYHLLNWNEAKNLCAKEDLYHPCPMIQNILWGFLHNIGEPLLMHWPCSKLREKALHYIMQHIHYEDENTNYICIGPVNKGYNGSQFWDVTFSIQAILAINLEDEYGSILKKANNFIKYSQITANSSGNLSHWY

SEQ ID NO: 10657 - protein, 249 aa, Hordeum vulgare subsp. vulgare
MSVSMNMRQNTVSTPIRRTTNPFDSDSDTEVPSRPLRAQSAPTQHTNQSVQELEDYTLRKAEETSSKVNDCVRAAEAIREDATQILLTLHRQGEQITHTHRVAADIEHDLTMSEKLLGSLGGLFSKTWRPKRSQHIKGPVSENSSFKSTSNEMEQRQKLGIASTPQKSPSSVHSAPATEMDKIKAEKARQDDAFADLSNILGGLKDMALDMGTEIDRQNKSLDTFGDDVDELNFRVKGANQRGRRLLGK

SEQ ID NO: 10658 - protein, 493 aa, Staphylococcus xylosus
MKRKLTGLFGAPVSDRENSMTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGHMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGIDINEVDLDVAD

SEQ ID NO: 10659 - protein, 180 aa, Neurospora crassa
MLAQRAGTTALRRVAAAPSSVFKLAPFAAMQTRPIQTERLTPADEAAILAKQRLNRPVSPHLEIYDPKQTWFGGSAWQRITGASFSGALYASAVAYLAAPLVGWHLESASLVAAAAALPVAVKGALKFLVAWPFVFHAINGVRHLAFDLGIGFSRATIIKTGWYFWGASIVGGVYLAFFM

SEQ ID NO: 10660 - protein, 316 aa, Ferroplasma acidarmanus
MEEIYLDKNENPFNVPEKVKKEFINYAKDADFNRYPEKGLPSLIKKLAGLTGFSSENIIAANGSDELLDILIRRAEGDIVVSSPTFEMYSFYARNYGHKAIDVPLRSDFSLDVNGILAQKDAKLVVICSPNNPTGNLIDRESIKKILDSGVTTILDNAYYEFSGEDYTDLIAKYSNLIILRTFSKAFSLAGMRIGYGIAESKFISEIKKLQAPFYMNILSAKMAEIMIDNYSLIVEKIKYIVEERERVYNEIKDIAYPSSANFLLLKKDLYGYMEENGIHIRKLPLVKDRSRLTIGTKDENKRAIEAIKKYVMEKF

SEQ ID NO: 10661 - protein, 182 aa, Triticum aestivum
  unsure (1)..(182): unsure at all Xaa locations
YSPWAPTVMASSATSVAPFQGLKSTAXGLPVSRRSNGASLGSVSNGGRIRCMQVWPIEGIKKFETLSYXCPPLSTEALLKQVDYLIRSKWVPCLEFSKVGFIFREHNAXPPGYYDGRYWTMWKLPMFGCTDATQVINEVEEVKKEYPDAYVRIIGFDNMRQVQCVSFIAFKXPPGCEESGKA

SEQ ID NO: 10662 - protein, 131 aa, Brucella melitensis 16M
MEAVDIYTRQCSTLVTATDLATMGATLAAGGVNPISGKRMVSAGNVAPILAEMTMEGLYTALGDWAYTVGLPGKSGVGGGIMAVVPGELAIAAFSPPLDPAGNSVKAMAAVAAVADSLGHNLYTTRGKVSS

SEQ ID NO: 10663 - protein, 797 aa, Escherichia coli CFT073
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRGNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLKKEWANDLDQLINLEKFADDAKFRQQYREIKQANKVRLAEFVKVRTGIEINPQAIFDIQIKRLHEYKRQHLNLLHILALYKEIRENPQSDRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 10664 - protein, 193 aa, Escherichia coli
MVVFISAALLGSPIRLMAVLGAICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 10665 - protein, 487 aa, Brassica napus
MGETAAANHHHHHHGHQVFDAYVPPQPAFKCFDDDGRLKRTGTVWTASAHIITAVIGSGVLSLAWAIAQLGWVAGPAVMLVFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIIFGVTEILLSQVPDFDQIWWISIVAAVMSFTYSAIGLALGIVQVAANGVFKGSLTGISIGTVTQTQKIWRTFQALGDIAFAYSYSVVLIEIQDTVRSPPSESKTMKKATKLSIAITTIFYMLCGSMGYAAFGDAAPGNLLTGFGFYNPFWLLDIANAAIVVHLIGAYQVFSQPIFAFAEKSASERFPDNDLLTKELEFKIPGFRSPYKTNVFRVVFRCSFVVLTTVISMLMPFFNDVVGILGALGFWPLTVYFPVEMYIKQRKVEKWSTRWVCLQMLSVACLVISVVAGVGSIAGVMLDLKVYKPFQSTY

SEQ ID NO: 10666 - protein, 307 aa, Saccharomyces bayanus
MSSSTKQQDSSFAINFLMGGVSAAIAKTAASPIERVKILIQNQDEMIKQGTLEKKYSGIVECFKRTAKQEGMISFWRGNTANVIRYFPTQALNFAFKDKIKLMFGFKKEEGYGKWFAGNLASGGAAGALSLLFVYSLDFARTRLAADAKSSKKGSSRQFNGLVDVYKKTLKSDGIAGLYRGFMPSVVGIVVYRGLYFGLFDSLKPVVLTGSLEGSFLASFLLGWVVTTGASTCSYPLDTVRRRMMMTSGQAIKYEGAMDCLKKIVAAEGVGSLFKGCGANILRSVAGAGVISMYDQLQMILFGKKFK

SEQ ID NO: 10667 - protein, 252 aa, Oceanobacillus iheyensis HTE831
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 10668 - protein, 126 aa, Glycine max
  unsure (1)..(126): unsure at all Xaa locations
LVHNHYYSLTSRCQLHRCAWLPVVSIKARQIFNSQGNPTVEVDLTCSDGTCAIAAGLSGAFTGMYEALELRDGGSDYLGQAGXYAASYANISLRPALIVKKIPEQTDIDNLMLYQRDGTAIERGRS

SEQ ID NO: 10669 - protein, 474 aa, Cryptopleura ruprechtiana
RYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIRGFYNTLLLSHLEVDLPQGIFFKQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTPDFVETPTANV

SEQ ID NO: 10670 - protein, 483 aa, Ralstonia eutropha
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 10671 - protein, 315 aa, Ochromonas danica
NGFGRIGRLVLRAARNKPDVQVVAINDPFIPVDYMKYMFYYDSVHGRYPQAPVVVENGKLIVDGKVISVSHELDPVNIKWGDSGADYIVGITGKKFLTEEGAAKHFVGGAKKIVMSGPSKNKTPMFVVGVNHKEYKKELLVVSNASCTTNCLAPLAKAINDNFGIKEGLMTTIHATTASQPTVDGHSLKDWRGGRGAVGINIIPSSTGAAKAVGKVIPALHGKLTGMAFRVPTANVSVVDLTVTLEKGAKYADIKEAVKAASNGELKGILGYTEDSVVSFHFVSDTRSSTFDANAGIALTDNFVKLVSWYDNEWG

SEQ ID NO: 10672 - protein, 426 aa, Glycine max
  unsure (1)..(426): unsure at all Xaa locations
MEMERIVEFPHTYMDRPPRKRARLGWDIAEVPKAQVGLFCGQEVENISSFAPSEHPPSSLFKGVARNGSPPWRDDDKDGHYMFELGDNLTSRYKIHGKMGEGTFGQVLECWDRERKEMVAIKIVRGIKKYREAAMVEIEVLQQLGKHDKGSNRCVQIRNWFDYRNHICIVFEKLGPSLYDFLRKNSYRSFPIDLVREIGWQLLECVAFMHDLHMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVXRRGRLDWPEGAISRESIKAVMKLPRLQNLIMQHVDHSAGDLIHLLQGLLRYDPFERLTARDALRHSFFMRDHLRR

SEQ ID NO: 10673 - protein, 396 aa, Carthamus tinctorius
MALRITPVTLQSERYRSFSFPKKANLRSPKFAMASTLGSSTPKVDNAKKPFQPPREVHVQVTHSMPPQKIEIFKSIEGWAEQNILVHLKPVEKCWQAQDFLPDPASEGFDEQVKELRARAKEIPDDYFVVLVGDMITEEALPTYQTMLNTLDGVRDETGASLTPWAVWTRAWTAEENRHGDLLHTYLYLSGRVDMRQIQKTIQYLIGSGMDPRTENSPYLGFIYTSFQERATFVSHGNTARHAKDHGDVKLAQICGTIASDEKRHETAYTKIVEKLFEIDPDGTVLAFADMMRKKISMPAHLMYDGRDDNLFEHFSAVAQRLGVYTAKDYADILEFLVGRWKVADLTGLSGEGRKAQDYVCGLPPRIRRLEERAQGRAKEGPVVPFSWIFDRQVKL

SEQ ID NO: 10674 - protein, 687 aa, Arabidopsis thaliana
MHGRKREEDPNPEETAAKALELRSLQSQFMSNHHQKIYTKEAIQLSAKLLITNPEFYTAWNYPKLAFESRLDEDSDPSLVNSIIDEELGVVQNALERNVKSYGAWYHRKWVLSKKGHYYPSLENELQLLNDYQKQAHQKQDDEKQDDPSRNFHAWNYRRFVVELTKTSEEDELQYTTDMISDISFTIYSAWHYRSVLVSSLVAKKADGFMPKETIRRELDYVHSAIFTLEEKQSGWFYYLWLLDQTVKMEIPLRFSSWPSDGSIIILSGPDCFNASSSTTKLTTFCSESGSFPLILYFDQAVSGVSSSTVTIGSELKDLVWEPVSDKKNSQVDSCVWVARLKFDCREPCFSRKETKVKVSLGGIVSSMGCNLTAPYEFVFTLRIHDTVEVELSQQESIVSWTDGFDNWDDNALSNDLNSLTALNADTGFEWRKKAIKIEIELFRTLPDSKIGKLILARLLMAEETMISNGVHYKEILQLYNDLMALDSWHNQYYKDEHSVALIHKVTSRTESMSRHLFRYRNMNNIICLRLNNLTLSRIAAVEKLLFVQMLDLSHNELHSAEGLEAMQLLCCLNLSHNRIRSFSALDSLRHLKQLRVLDVSHNHICGELPVDTTRYLCSSPLSNSGETGREVPNKYQDAYLVLRDLMKLKQLDIRGNDLIFAGEEFSSFVRQVVPKLVWLDGHKLTS

SEQ ID NO: 10675 - protein, 354 aa, Prunus armeniaca
MGSVRASHELLQAQAHIWNHIFSFINSLSLKCAVQLDIPDVIQKHGQPMTLSELVSALPISPTKAHFIPRLMRILVHSGFFAKESLSGCGEQGYILTDASALLLKDNPMSARPFLLAMLSPILTDPYQYLTTWFQNDNPTPFHVVNGMTCWDYVNQDPTLAHFFNDAMASDAQLISSLVIDDCKEVFQGVDSLVDVGGGTGTVAKSIADAFPHMKCTVLDLPHVVADLKGSKNLEYVAGDMFEAVPAADAIFLKWILHDWSDEECVKILERCKAAVTREGKKGKVIIVEMTVENKNTDKESGETQLFFDMHMMVMSTGKERNEKEWAKLFSDAGFSQYKITPLFGFKSLIEVYP

SEQ ID NO: 10676 - protein, 131 aa, Triticum aestivum
  unsure (1)..(131): unsure at all Xaa locations
MAATIQSVKARXIFDSRGNPTVEVDVCCSDGTFARAAVPSGASTGVYEALELRDGGSDYLGKGVSKAVDNVNLIIAPALIGKDPXTAQTEAPTNFMVQAXLIGTQKTEMGFGWQKQKAWVAKWQSLGVCQS

SEQ ID NO: 10677 - protein, 188 aa, Limonium latifolium
HGTTRSRHGSSSSSSPTANGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 10678 - protein, 364 aa, Glycine max
SAREEIDYINEGKNADRFRRDFRNIKWVRIPLVYWDYTALKVLTMEYVPGIKIDQVDTLTSRGYDRLRISSRATEAYLIQILKTGFFHADPHPGNLAIDVDEAIIYYDFGMMGQIKSFTRERLLELFYAIYEKDSKKVMQRLIDLGALQPTGDLSSVRRSVQFFLDHLLSQAPDQEQTLSAIGEDLFAIAQDQPFRFPSTFAFVLRAFSTLEGIGYTLNPNFSFSKIAAPYAQELLEIRQKQRTAPQLVEEIRKQADDATTYTMSMPYRVQRIEEFTKQLEAGDLKLRVRVLESERAARKATGLQMATMYTVLGGTLLNLGITMSSQGNITIANGSFIGAGIFMTLFVRSMQRVKMLDKFEKMI

SEQ ID NO: 10679 - protein, 301 aa, Mycobacterium tuberculosis H37Rv
MARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 10680 - protein, 247 aa, Triticum aestivum
  unsure (1)..(247): unsure at all Xaa locations
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKARVDNLQRTQRXNLLGEDLDSLGIKELESLEKQLDSSLKHIRTTRTQHMVDQLTELQRREQMFSEANKCLRIKLEESNQVHGQQLWEHNNNVLSYERQPEVQPPMHGGNGFFHPLDAAGEPTLHIGYPPESLNSSCMTTFMPPWLP

SEQ ID NO: 10681 - protein, 177 aa, Triticum aestivum
ASMQEQISSSFMESPPPPPPAHLDGPFFGADLLPSARLRRMRGYRPSPGGLKEEIMMFQTRVLLGGMNMYDRYQDWRLDVDNMTYEELLELGERIGHVNTGLREDEIVRNLRKVKPDSSFRLPTEAEKKCSICQEEFEANDELGRLGCGHSYHVYCIKQWLSQKNVCPVCKTAVTKT

SEQ ID NO: 10682 - protein, 545 aa, Zea mays
  unsure (1)..(545): unsure at all Xaa locations
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGSTPXASVMATLCFFRFWLGFGIGGDYPLSATIMSEYANKKTRGAFIAAVFAMQGFGILTGGLVTLIVSASFKARFPAPAYAVDPAGSTPPQADFVWRIILMLGAMPAALTYYWXRTKMPETARYTALVAKNAKQAAADMSKVLQVEISAGAPEEDAAAAAATAPAPASASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIVGSFGFLYLAQNRDPAKTDHGYPAGIGVRNSLFLLAGCNLLGLAFTFLVPESKGKSLEEMSGENDEAAAAAATPNYNNRTVPV

SEQ ID NO: 10683 - protein, 484 aa, Schizosaccharomyces pombe
MSLHDAYHWPSRTPSRKGSNIKLNKTLQDHLDELEEQFTIPTELLHRVTDRFVSELYKGLTTNPGDVPMVPTWIIGTPDGNEHGSYLALDLGGTNLRVCAVEVQGNGKFDITQSKYRLPQELKVGTREALFDYIADCIKKFVEEVHPGKSQNLEIGFTFSYPCVQRSINDASLVAWTKGFDIDGVEGESVGPLLSAALKRVGCNNVRLNAILSDTTGTLVASNYASPGTEIGVIFGTGCNACYIEKFSEIPKLHKYDFPEDMNMIINCEWCDFDNQHVVLPRTKYDVAIDEESPRPGLQTYEKMIAGCYLGDILRRILLDLYEQGALFNGQDVTKIRDPLAMDTSVLSAIEVDPFENLDETQTLFEETYGLKTTEEERQFIRRACELIGTRSARLSACGVCALVRKMNKPSMIVGTDGSVYNLYPRFKDRLAQAFKDILGEEIGSKVVTIPAEDGSGVGAALVSALEAKGKALTSDILAEHLKN

SEQ ID NO: 10684 - protein, 525 aa, Oryza sativa (japonica cultivar-group)
MAAAIIGVGGGGWTRLRSIGHGASGATVSLAADDASGELFVVKSAGDAVAATARQQLRREWSVMSGLSSPHVLRCLGFVQAAAGAGGEHQLLLEYAPGGSLADVVARNGDRLDESAFRAYAADVLRGLDYLHEKLVVHGDVKGSNVLVGADGRAKLADFGCARVVMPGGSKQPVLGGTPAFMAPEVARGEEQGPAADVWALGCTVIEMATGRAPWSDMDDVLAALRMIGYTDAVPDLPPWLSPEAKDFLRRCMQRRAGDRPTAAQLLQHPFVSKSCGLKKEVVKATWVSPTSALDAAAALWESETSSSTDDEEADDMSNSPTGRIIAMASSGGQTLPDWDSDDHGWIEVLGTVSINIAKKKTAAAEDYEASESPAKRVRAMACSPSSVPDWDSDNHGWIDVLSASPADDNGGEGNAPEEFDVVAAADQIFGEAVGSIVVGVGSEQSVVVENQEDEFISLSYCSERILLVAVHAADNNAASRKAGIKECSHDPRPSIPSRCAHNLFLSLIFIQIDNSNVVPFAPKY

SEQ ID NO: 10685 - protein, 295 aa, Desulfitobacterium hafniense
RNHAKGVCVIGRFDSSGAAAAYSRAAVFAAGASTPLVGRFALPGGNPYAPDGGVPIRSFALRLTQPDGQQWRTGMNNMPVFPVATPQAFFEQLRATAPDPATGKPDPAKQKAFFEAHPETAAFRAWIKGRKPSASYATDSYYGLNAFYFVAADDARHAVRWRVEPNNGAAAAPLGAQDTDALAAELERRLAQGPLRWKLWATLAAPGDPVDDATQVWPAQREQIDAGTVIVERAQDQASGECRDINYDPMVLPDGILASADPLLPARSAAYAESYRRRTAEEARAGGRPPQEAAR

SEQ ID NO: 10686 - protein, 326 aa, Methanosarcina acetivorans C2A
MEVLWLAQEEVKSVVDMHSDMQVVESAFRQHGLGKVQMPPKSYLYYTVYNGDLRTMPAYLEEEDITGVKIVNVHPGNPMRNLPTVMALIILISPETGAPVAIMDGTYLTDIRTGAAGGVAAKYLARKDSKVIGLVGAGNQARTQLEALCEVFEPETVRITSRTKESCDQFIKEMSDFVPCEILYEESVEKVCDCDILVTTTPTRKPIVKASWVKEGTHINAIGADAVGKEELDPELLLRSKIIVDDMVQALHSGEVNVPLSKHYISENDIHAQLGEVIVGLKPGRTSEEEITIFDSTGLAIQDVATAHMVYERAVREGLGRQVRMF

SEQ ID NO: 10687 - protein, 697 aa, Azotobacter vinelandii
MLSMPGAEPSAAARRKTRIFFATLGQDLSVPRPESVQRSTARPGSRLPGRVPPAPAWRTVRGTGYRTPVAALRSHAFAPDGSPPCRSVRISDSHPARFAMATTVGDFLVERLYQWGVRRIYGYPGDGINGVFGALSRAREKIRFIQVRHEEMAAFMASAEAKFGGGLGVCIATSGPGASHLITGLYDARLDHMPVLAIAGQQARTAMGGHYQQEVDLVSMLKDVAGAFVQQASAPEQVRHLVDRAIRTALGERRVTAIVLPNDLQEMDYSEPPHAHGTLHSGIGYSRPRKLPYDEDLQRAAEVLNAGSKVAILVGAGALGASDEVIQVAERLGAGVAKALLGKAALPDELPWVTGSIGLLGTEPSYKLMSECDTLLMIGSGFPYSEFLPREGQARGVQIDLKADMLGLRYPMEVNLEGDAAETLRALLPLLLEKEDRRWRADIEEWRGDWEKKLERRALASAKPINPQRVVFELSPRLPERAVVTCDSGSCANWFARDLKIRRGMMCSLSGGLASMGAAVPYAIAAKFVHPERAVVALVGDGAMQMNNMAELITVAKYWREWRDPRWICCVFNNEDLNQVSWEQRVMAGDPKFEASQDIPDVPYHRFAESIGLRGIYVDREDLVAAAWEEALAADRPVLIEFKTDPDVPPLPPHITLEQAGKFAGTLLWGDPNQAGIIAQTAKQVLGSVLPGRHRDG

SEQ ID NO: 10688 - protein, 1211 aa, ASPERGILLUS NIDULANS FGSC A4
MDSGRAQVDASLSQASPDEQLDGPAGDSAKRKAEQPANGTQTRSKRNRHPVTVAATSSWNVRRYAPNCCNNNFKDSEEFRSMKEQIASLQDQVTSLFSSISELRAQRSTFDTPAFDNFSRDGSQVFTSMRPPTGKPRFKHARFHGPTSSAFNFDVARSSLQHMGIAPVEETMPDDITTGHATPAASPPHIPALTQPMHPSKDPIWAIKKDEALRLCRVYEEEIGIMYPLVDIDHVVQQVNLLYTFMEAAIRTGLMHRGLAGTDGLEDDSTNIIKLIFATILVVEGGGQSQLGQRLYLSVKPAIESKIWDTLDVKTIQLLGLMATYHFHTDEDALAYRIIGVASRMCLEMGLHRRDALAKNFPDEAQWPDIVRIFWSIYSLDRRWSLGTGLPFSMHDEDIDQMEPDPSLQYLRCMITYNRIISKVWYSGLGSDGATDIRRDEIGYLDYQVLQWYKQIPDSLKFYPAESPRQGEAASRGLRRLRILLYLRMNQLRILIYRPVLHSAASIAEDKGHAQTVVDVAKDTVRILTRLNQTSDIYRTQQITFNYFLVAALAVLFLAVCHAPNEFNRQVRDEFYLALDLVNGFSTKSYVSKRLWKTIKGLRQIGERLGVLERPYGPDANDPHSTAAVAMAGLAGHPMEDLSVYGALNGVGELGNSPLNGLQMSHELTTLFEAVGGFGNFMGTTAADSINGFIGHEGELQNTGEGLSALRCIKVDAAHRPTRLIWRSILASVDRSPQQPAAKNSPSNAGASSASPPHNQHINDPSAYQEEYHLLTIPRLVRAQHLRSFIRHLRSPAFDSSLLEVSTVSREVGSALADGLDRLDLSQLSESTPSSTVPSDSFDMSSSDGAPESWISSFCQLMGHEFFAEVSEDFIEDDFNLTGLQSQVPMYKEALEMILDVEPEEDEEEEEEEEEEEDEDEILGDEKPPGYRRERRHTRVASDLSMIETSAELLYGLIHQRYITSRPGIQQMLEKYELQHFGVCPRVHCNGCKVLPVGRSDTPGQETVKLFCPSCQDLYTPPNSRFHSVDGAFFGTTFGCLFFMTFPDLEIGPRFDAPLSNISPPRSASLPSTATTTTTTTTTSAGASNQVTSDTPRPVYPVELNGVRTVNFCPGLGEGRVYESRIYGFRVSERSRAGPRMKWLRMKPADITELDEMSRFKALQNYDDDGDADMGEDNAQNANSAIAQRKKAPMRRRRYNPDQMNINGVDG

SEQ ID NO: 10689 - protein, 360 aa, Atriplex nummularia
MAKVKIGINGFGRIGRLVARVILQSDDCELVAINDPFITTDYMTYMFKYDSVHGQWKHHELKVKDEKTLLFGERPVTVFGNRNPEEIPWGQTGADYVVESTGVFTDKDKAAAHLKGGAKKVIISAPSKDAPMFVVGVNEHEYKSELNIVSNASCTTNCLAPLAKVINDKFGIVEGLMTTVHSITATQKTVDGPSAKDWRGGRAASFNIIPSSTGAAKAVGKVLPALNGKLTGMSFRVPTVDVSVVDLTVRLEKEATYEQIKAAIKEESEGKMKGILGYTEDDVVSTDFVGDNRSSIFDAKAGICLNGNFVKLVSWYDNEWGYSSRVVDLIRHMSKTTSKLDSVALACVDAVSTLILSSEC

SEQ ID NO: 10690 - protein, 391 aa, Thermosynechococcus elongatus BP-1
MISVETAVDLIQQHLPNWGTEIISLSEPWYRRLAVAISSDRPYPPIDRIMVDGIALRWAAYGSGQRSFPILGVVPAGEVPPTLTDPQACFEVMTGAALPQGCDLVIPYEALEIRDSIAHIRHPEPWSPYQFVHRCGSDALAGQQVLAAGTPLHSPAWGILASVGQIKVPVRRPPRTQIIATGNELIPPNEVPQPYQLRLSNAYALMAALRRQGYTHVSISHLPDDPVQLATHYRQASQEYDLLIYCGGVSKGKFDYLPQLWRDHGVQQYIHGVAQRPGKPLWFGVDHTQQTAVFGLPGNPVSSLVCLHRYVLDIVPLYARLSSPFSFEKPLTYFLPVKLEITKNAELIAHPRPMQNSGDFLALADSDGFLELPALQGVFAAGECYRYFPWS

SEQ ID NO: 10691 - protein, 485 aa, Nicotiana plumbaginifolia
PSSAFNSPFCTTNSGAPVFNNNSSLTVGARGPVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEDEAARVGGANHSHATQDLYDSIAAGNYPEWKLFIQTMDPDHEDRFDFDPLDVTKTWPEDILPLQPVGRLVLNKNIDNFSNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVIQKENNFKQPGERYRSFTPDRQERFIRRWVETLSDPRITYEIRSIWISYWSQADKSLGQKLASRLNVRPSI

SEQ ID NO: 10692 - protein, 380 aa, Acremonium chrysogenum
MTTTYKILVLPGDHIGPEIMAEAIKVLTTIETHRPNLHFNLTTDLVGGTSIDTHGVPITQSVLDAAKASDAVLFGSIGGPEWAGVHPTPESGLLQLRQHLDAFANLRPCEFLVPSLVGASPIREHVVKGTRFIVVRENCGGAYFGEKKEEEDVASDLWVYTRPEIERLARVSAAVARIMGRSEDDNQAATVWSADKANVLASGRLWRRITSDIFAKEFPDITLQHQLADSMAMLMVRDPRRFNGVIHTDNTFGDILSDISGAITGTLGLMPSASLCGVPGEGHRSNGIYEPVHGSAPDISGKGLANPVAQILSVAMMLRYSMGLEKEATAVERAVVKVLDAKSEGGLEIRTGDLGGRATCSQVGDAVCEVLGPLLQGKKA

SEQ ID NO: 10693 - protein, 256 aa, Brassica oleracea
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGCFAA

SEQ ID NO: 10694 - protein, 714 aa, Paenibacillus macerans
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGGMYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 10695 - protein, 193 aa, Yersinia frederiksenii
GWKGINESDMVLMPDASTAVMDPFFEDSTLIIRCDILEPGTMQGYDRDPRSISKRAEDFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 10696 - protein, 269 aa, Zea mays
  unsure (1)..(269): unsure at all Xaa locations
MSFSSMSKQQVLDAGDGEGEEVVELIPGLPEEVAEKCLLHLPFLYHRLFRTVSSTWNRFLTDSPAKPLLFTPAEGAGAGAGSAAMGSLSLSLPFLFAFAFDPVSRRLQCQALDPFSRRWLLLPPVPGGAAAGSFAGVGLPRRGEIYVIGGVEEGSDKAVTSXSLYSAARNGWEEAAAMRTPRGYMAAGEVGXAGGXAGEDGEAEVFDPDAGRWSPAAPRRGAAVAWYDAAAAGGKLFVTEGWAWSFERAPCGAVFYFVTVFCCEMVRGM

SEQ ID NO: 10697 - protein, 645 aa, Eremothecium gossypii
MRFRFQQFRFFGAPRAGARWRALVPPVLMLPAAAAASRQLLAPVRCDALLPDARGDTYEMGLYLASQRELREARERRRDGRGRGGVLRVLRMLLYGLHDAVVEPVRTVLRLLQLSAVFVPVLLAFPVTLVGRTVRAGSHGERSETQGALLWYRLVRKALEWAGPSFIKLGQWAGSRTDIFSEGLCAELGRLHSSAKPHGLQYTKRAIVEALGVQSFEEVFEEFREQPLGCGAIAQVYVGKLREELVRAKGVDLGPGGNRWCAVKVVHPHAARQISRDLRLMRFFAAAVDALPTMEWLSLPAEVEQFSILMNIQLDMRIECNNLAKFNDNFRGHTQIRFPRGFVELTSRSVLFEEYIDGFPMKAFLKVKNRIGDTSLCQKVSEPFISSFLKMMILDDFIHSDLHAGNVMLRFVRTDKLERHILSPEDETSDVVRRLVGMHRDHDPGFDVALREVLRDYTPQICFIDTGLITELNERNRTNFIALFNALAQFNGRRAGELMIERSRTPETAVDKDAFALKVDRLVKTVKQRTFTLGTVSIGDLLEQMLSMVRTHHVRMEGDFVSVVVAILLLEGIGRQLDPELDLFASSIPFLREFGMRRENQRMLHDMGRWPMLKVWLGLELRQLMTLSVRIINDLVKTDQLCPSY

SEQ ID NO: 10698 - protein, 477 aa, Zea mays
GALRVVVLPLPQVMILLVVPKVGLSAANYAKNLLRVTVLLQYVPRIIRFVPLLDGQSTNGFIFESAWANFVINLLMFILAGHVVGSCWYLFGLQRVNQCLRDACSISTIPYCDSFIDCGRGIGSGLYRQQWFNDSGAEACFNTGNDATFQYGIYEQAVLLTTEDSAVKRYIYSLFWGFQQISTLAGNLVPSYFIWEVLFTMAIIGLGLLLFALLIGNMQNFLQALGRRRLEMQLRRRDVEKWMSHRRLPEDLRRRVRRAERFTWAATQGVNEEELLSNLPEDIQRDIRRHFFRFLNKVRLFTLMDWPILDAICDKLRQNLYISGSDILYQGGTVEKMVFIVRGKLESISADGSKAPLHDGDVCGEELLTWYLEHSSANRDGGKIKFQGMRLVAIRTVRCLTNVEAFVLRASDLEEVTSQFARFLRNPRVQGAIRYESPYWRTIAATRIQVAWRYRKRRLKRAEKSRLSEETYASLGS

SEQ ID NO: 10699 - protein, 394 aa, Zea mays
MALSIYTPTSSSLVPPSIQEVRLTSRPPKPATFSLRRPHLAARAAAGNAPTSPVREVVTELDAVAGFSEIVPDTVVFDDFERFAPTAATVSSSLLLGITGLPDTKFKSAIDTALADGECNALEKAEDRMSCYLTKALANVGAELAHQVPGRVSTEIDARLAYDTQGIIHRVHELLNLYNQHDVSTDRLLFKIPATWQGIEASRLLESEGIQTHLTFVYSFAQAAAAAQAGASVVQMFVGRLRDWARHHSGDPEIDEALKNGEDAGLSLAKKVYAYIHRNGYKTKLMAAAIRNKQDVFSLLGIDYIIAPLKILQSLEESVTDPDVKYGYVPKLTPAIGKTYNFTEEELVKWDQLSLSAAMGPAAEELLASGLEGYVNQARRVEELFGKIWPPPNV

SEQ ID NO: 10700 - protein, 183 aa, Oryza sativa
ITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKV

SEQ ID NO: 10701 - protein, 396 aa, Linum usitatissimum
MALKLNPVTTFPSTRSLNNFSSRSPRTFLMAASTFNSTSTKEAEKLKKSHGPPKEVHMQVTHSMPPQKLEIFKSLEGWAEDVLLPHLKPVEKCWQPQDFLPEPESDGFEEQVKELRARAKELPDDYFVVLVGDMITEEALPTYQTMLNTLDGVRDETGASLTPWAIWTRAWTAEENRHGDLLNKYLYLSGRVDMRQIEKTIQYLIGSGMDPKTENNPYLGFIYTSFQERATFISHGNTARLAKDHGDMKLAQICGIIAADEKRHETAYTKIVEKLFEIDPDGTVLALADMMRKKISMPAHLMYDGEDDNLFDNYSSVAQRIGVYTAKDYADILEFLVGRWKVDAFTGLSGEGNKAQDFVCGLPARIRKLEERAAGRAKQTSKSVPFSWIFSRELVL

SEQ ID NO: 10702 - protein, 323 aa, Zea mays; identical to SEQ ID NO: 4205

SEQ ID NO: 10703 - protein, 215 aa, Oryza sativa (japonica cultivar-group)
MEKAACNEHVIGIPVSNRAFGIEEPDFPSEGAAAYHAEAKSSATARTSSRFGRTGDRLAQGIKEHVTLGPKLYETMKGKLTLGARILQAGGVEKVFRRWFAVGKGEKLLRASQCYLSTTAGPIAGMLFISTERIAFRSDRSLALTTPSGDTVRVPYKVAIPLRRVKTAKPSENKHRPEQKYVQVVTDDGFEFWFMGFVSFQVTLKNLELAVAQAQ

SEQ ID NO: 10704 - protein, 208 aa, Zea mays
MPPPPPKKKNLLKSFMGNGKDALQQVGTKQRHGGGGGGLPRLSASSKALVLLPLLLLAFIFLFVYPKEFELQAMLSACGPAAAEPAAVRKPEFRLLIGVLTRADLYERRHLLRMVYGLQLASPGGLAAHVDVRFVFCRLYKDDQRVLVPLEILAHGDVIVLDGCEENLNGGKTYTFLSAVAALYADEPYDYVMKADDDIFLRLPQGCR

SEQ ID NO: 10705 - protein, 397 aa, Pyrobaculum aerophilum str. IM2
MGGSMRGFSPRIGALRESPTRKIDELREKLRRENRDVILLSTGQPSIPPPREVREALGELLKVDTMELYGYTPSQGIYEVRQAISEDLRRLGGLEVPPEQIVLTAGGQAAMFSTLATLIEPGDEVVVTDPTYFGYKPLLEYFGAVVKPVRTRLEDGFQPNPEALKDSVSRKTKALILVSPDNPTGRALKEEAAKAVVDLAEDYDFWIITDEAYKTLIYEGSHIYLYKLAPDRTISINTFSKDPAIPGWRLGYVYGPPEVMPKIKLVNEEMVYCPPSFAQRLVAIYLRSEARMRYIREVVEIYRQKRDVAVAALRKYVPEARFIVPAGSMFIFVDLSRYISDGESFARELLERYGVAVVPGSYFSEIYRAAVRISFVTEPPHRLEEGIRRIGEALKAT

SEQ ID NO: 10706 - protein, 601 aa, Arabidopsis thaliana
MFVAKNLSPERESKRQKKEPEIMEPSFPLLSPNNCGHWYIRYGFCIVCKSTVDKTIEGRVFDGLHLSSEALALTKRLITKFSCLNMKKLHLVLDLDLTLIHSVRVPCLSEAEKYLIEEAGSTTREDLWKMKVRGDPISITIEHLVKLRPFLCEFLKEANEMFTMYVYTKGTRPYAEAILKLIDPKKLYFGHRVITRNESPHTKTLDMVLADERGVVIVDDTRKAWPNNKSNLVLIGRYNYFRSQSRVLKPHSEEKTDESENNGGLANVLKLLKGIHHKFFKVEEEVESQDVRLTMSVVENFSSEPKAKRRKIEPTINESSSSLSSSSSCGHWYICHGICIGCKSTVKKSQGRAFDYIFDGLQLSHEAVALTKCFTTKLSCLNEKKLHLVLDLDHTLLHTVMVPSLSQAEKYLIEEAGSATRDDLWKIKAVGDPMEFLTKLRPFLRDFLKEANEFFTMYVYTKGSRVYAKQVLELIDPKKLYFGDRVITKTESPHMKTLDFVLAEERGVVIVDDTRNVWPDHKSNLVDISKYSYFRLKGQDSMPYSEEKTDESESEGGLANVLKLLKEVHQRFFRVEEELESKDVRSLLQEIDFELNVESVE

SEQ ID NO: 10707 - protein, 506 aa, Lotus japonicus
MAAAFTCSAADLHPLLGTGANATAAAEFICSRFGAISNKFTDTAYAVDNTYLLFSAYLVFAMQLGFAMLCAGSVRAKNTMNIMLTNVLDAATGGIFFYIFGFALAFGTPSNGFIGKHFFGLNEFPSPSFDYGFFLYQWAFAIAAAGITSGSIAERTQFVAYLIYSSFLTGLVYPIVAHWFWSSDGWGSPARTENLLFGSGVIDFAGSGVVHLVGAVAGFWGAFIEGPRMGRFDHAGKPVPLRGHSGTLVVLGTFLLWFGWYGFNPGSFITILKSYGESGSGNYYGQWSAIGRTAVTTTLAGCSAALTTLFGKRLQTGHWNVTDVCNGLLGGFAAITSGCSVVDPWAAIICGFVAAWVLIGCNVLAEKFHYDDPLEAAQLHGGCGTWGIIFTALFAKKQYVNEVYAGLPDRPYGLLMGGGWRLLAAHVVQILTIAGWVSVTMGAVFFVLHKLNLLRISPEEEMAGLDMTSHGGLAYEYHEDVGSVQKALKFVFDFYCKGNYYKTLLE

SEQ ID NO: 10708 - protein, 443 aa, Clostridium saccharobutylicum
MAKYTKEDIINLVKENGVKFIRLQFTDIFGTLKNVAITDKQLEKALDNECMFDGSSIDGFVRIEESDMNLRPNLDSFVIFPWRPQQGKVARLICDVYKPDGTPFEGDPRHVLKRANADAKELGYTMNVGPECEFFLFETDENGRATTNTQDKAGYFDLAPTDLGENARRDMTLALEEMGFEIEASHHEVAEGQNEIDFKYGDALTTADNIMTFKLVVKSIAQRHGLHASFMPKPIFGINGSGMHVNMSLFKDGKNAFVDENDKNGLSKVAYQFIAGLLKNIKGMAAVTNPLVNSYKRLVPGYEAPVYLAWSCKNRTALIRVPAARGAGTRVELRCPDPSSNPYLVLACLLQAGLDGIKNNLQPPAEVEANIFAMTEQERKENGIDNLPNNLYEAVNYMKENELAKKALGDHVYGNYVAGKAAEWDDYRTKVHDWELENYLNKY

SEQ ID NO: 10709 - protein, 178 aa, Helianthus annuus
MASISSSVATVSRTAPAQANMVAPFTGLKSNAAFPTTKKANDFSTLPSNGGRVQCMKVWPPLGLKKYETLSYLPPLTETQLAKEVDYLLRKKWVPCLEFELEHGFVYRENARSPGYYDGRYWTMWKLPMFGCTDSAQVMKELAECKKEYPQAWIRIIGFDNVRQVQCIMFIASRPDGY

SEQ ID NO: 10710 - protein, 448 aa, Streptococcus pyogenes MGAS8232
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPIEANIYTMTMEERNEAGIIDLPSTLHNALKALQKDDVVQKALGYHIYTNFLEAKRIEWSSYATFISQWEIDHYIHNY

SEQ ID NO: 10711 - protein, 310 aa, Oryza sativa
MASAAVPEWLNKGDNAWQMLSATLVALQGFPGLALFYVGAVPRKWALTSAFMALYAMAATMPCWALWAHNMAFGRRLLPFVGRPAPALAQDYMLSQALLPSTAAVAPLYPSASMVFFQWAFAGVTVGLVAGAVLGRMSVKAWMAFVPLWTTLSYTVGAYSIWGGGFLFHWGVMDYSGGYVVLLAAGVSGYTAAYWVGPRRKEEDEEEMATASGGNLVVMVAGAGILWMGWTGFNGGDPFSANTDSSVAVLNTHICATTSIVAWVCCDVAVRGRPSVVGAVQGMITGLVCITPRSNYVVAWRGVISRNMLG

SEQ ID NO: 10712 - protein, 477 aa, Xylella fastidiosa Temecula1
MFKQLWATKLSQPSQDSAEGLSMQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFTAVCAGVLILRCTRPDLPRPFRMPAAWLFCSAGVLSCITLLSAMTRHNWMLMSVWTVLGFSLYFSYGYRHSKLHQEST

SEQ ID NO: 10713 - protein, 174 aa, Triticum aestivum
MADEKLAKLREAVAGLGQISDKEKSGFISLVSRYLSGNEEQIEWGKIHTPTDEVVVPYDTLAAPPEDLAATKALLDKLAVLKLNGGLGTTMGCTGPKSVIEVRNGFTFLDLIVVQIESLNKKYGSNVPLLLMNSFNTHDDTLKIVEKYANSNIQIHTFNQSQYPRVVADEFLPL

SEQ ID NO: 10714 - protein, 522 aa, Candida tropicalis
MTAQDIIATYITKWYVIVPLALIAYRVLDYFYGRYLMYKLGAKPFFQKQTDGYFGFKAPLELLKKKSDGTLIDFTLERIQALNRPDIPTFTFPIFSINLISTLEPENIKAILATQFNDFSLGTRHSHFAPLLGDGIFTLDGAGWKHSRSMLRPQFAREQISHVKLLEPHMQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVSKALDLTPEQLEKQDGYVFLYELVKQTRDRQVLRDQLLNIMVAGRDTTAGLLSFVFFELARNPEVTNKLREEIEDKFGLGENARVEDISFESLKSCEYLKAVLNETLRLYPSVPQNFRVATKNTTLPRGGGKDGLSPVLVRKGQTVMYGVYAAHRNPAVYGKDALEFRPERWFEPETKKLGWAFLPFNGGPRICLGQQFALTEASYVTVRLLQEFGHLSMDPNTEYPPRKMSHLTMSLFDGANIEMY

SEQ ID NO: 10715 - protein, 62 aa, Zea mays
GGAKFPSFPPVAPLLSSLPKAPLFPPGPPVVTPLSNQRAFLETFIRACVGLPPKNTLFLGSK

SEQ ID NO: 10716 - protein, 294 aa, Helianthus annuus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKTGLDLLRKMLCLDPSKRITARTALEHEYFKDIGFVP

SEQ ID NO: 10717 - protein, 498 aa, Arabidopsis thaliana
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSATPPRV

SEQ ID NO: 10718 - protein, 539 aa, Lupinus albus
MARDELSVLTALDVAKTQWYHFTAIIVAGMGFFTDAYDLFSIANVTKLLGRIYYTHQGAPKPGTLPPNVSLAVNGVALCGTLTGQVFFGWLGDKMGRKKVYGLTLAIMVFASLASGLSFGHTAKGTVSTLCFFRFWLGFGIGGDYPLSATIMSEYANKKTRGAFIAAVFAMQGFGILFGGIVSLVISTIFDHAYSAPAYEVDAEASLVPQADYVWRIILMLGALPAALTYYSRMKMPETARYTALVARNAKQAAQDMSKVLQVEIEAEQDMVDKLSERDNNNFGLFTKEFAKRHGKHLIGTCTTWFLLDIAYYSSNLFQKDIYSSIGWLPPAKEMNAIHEVFRVSKAQVLIALCGTVPGYWFTVAFIDHLGRFFIQLMGFFFMTVFMFALAIPYDHWTKKDNRIGFLVMYALTFFFANFGPNSTTFVVPAEIFPARLRSTCHGISSAAGKAGAIVGAFGFLYASQSKDATKRDVGYPAGIGMKNTLIVLAVCNCLGMFFTFLVPESKGKSLEELSGENEDEGTNETSQQPAASNRTVPV

SEQ ID NO: 10719 - protein, 495 aa, Gracilaria gracilis
MNRDSRSLQDFKGVMDKSAASTVAEKLTVMNQMAANELEKMTDSETTGFVELYGRYMSERSKKAEIKWDLIEQPSENMLQKYDTLPKPATDEELASLLSKLAVLKLNGGLGTSMGCKGPKSVIEVRDDTTFLDLIVQQIGQLNKNHPTANVPLLLMNSFNTDSETAKIIRKYQDTSVTLTTFQQSRYPRIVKESLEPMPLTHDHYAHEDWYPPGHGDFFQSIYNSGLVDTLLAQGKEYIFVSNVDNLGATVDLNILKNVVDREVEYCMELTDKTRADIKGGTIISYDGKVSLLEVAQVPAKYVEEFKSISKFKVFNTNNIWVSLRAIKRVMQSGEMKLDIIVNNKEVKGTKVIQLESAIGAAIGYFNNACGVNVPRSRFLPVKSTSDLMLIQSNMYNLKSGSLVMNPARQFTTTPVIKLGKEFKKVAQYLERLGSIPDILELDHLTVSGDVYFGANTTLKGTVIVVANPGNTIMIPEGSVLENKVVLGSLHVIPH

SEQ ID NO: 10720 - protein, 244 aa, Vitis vinifera
MGRGRVELKRIENKINRQVTFAKRRNGLLKKAYELSVLCDAEVALIIFSTRGKLYEFCSSSSMLKTLERYQKCSYGAVEVSRPSKELEQSSYREYLKLKSKFEALQRTQRNLLGEDLGPLNTKELEQLERQLETSLKQVRSTKTQFMLDQLSDLQNKEQVLVESNKALTRKLDEISVKNHLQLSWESGEQSMPYGHQQAQSQGFFQPLECNPTLQIGYNPAGSSQLSAPSNAQNVNGFIPGWML

SEQ ID NO: 10721 - protein, 274 aa, Antirrhinum majus
RNWGFFELVNHTIAPEFMDTVERLTKEHYRKCMEQRFKEMVESKGLEAFESEIEDLDWESTFFLRHLPVSNISEIPDLDDEYRKVMKEFASQLEKLAEQLLDLLCENLGLEKGYLKNAFYGSKGPTFGTKVSNYPPCPKPDLIKGLRAHTDAGGIILLFQDDKVSGLQLLKDGEWVDVPPMRHSIVINIGDQLEVITNGKYKSVVHRVIAQPDGNRMSLASFYNPGSDAVIYPAPALVEKGESKDLYPKFVFEDYMKLYAGVKFQAKEPRFEAM

SEQ ID NO: 10722 - protein, 243 aa, Lactobacillus gasseri
MKEGELMNNFSQEPERRTIVDVTGLNRFLSRMYGMMTIAVLVSALSAYLTMTVFRTQVMTLFASNPAMTWILLLVPLALTFGISFRATRNPVASFVMLMIMAIVYGVEFSLIAGAYTGRSIASAFVASSTVFITMAVIGTTTKKNLNNLGSYASAALIGLIVAMLINMFLRNPMVSYIFSFIAVIIFTILTAWDAQRMKQIYENYGGQVSVDGLAVAGALALYLDFVNLFLQFLQIFGFSDRN

SEQ ID NO: 10723 - protein, 370 aa, Triticum aestivum
DLFSLSLVVDLISQRYYTGGPIPTHISVYINAAALCGTVPRQLVFGWLGDKMGRKRIYGVTLLLMVFCSLASGFTFGKSNYKSVVITLCFFRFWLGVSIGGDYPLSATIMSEYANMRTRGAFLSAVFAMQGFGNVVAGLVGMITSQAFKKSSPDNIDFVWRIVLIFGAVPALLTYYWRMKMPETARYTALIAKDADMAAADMSAVLSMHIAPEEDSLGSQDQYGLFSSEFRQRHGLHLLGTTVCWFILDVTFYSLNLCMKDIFTTVGLLEGHDDEVCKVNSCQGASYHKADNPFQRTIDITAMHMAIAAGCTLPGYFFAVAFIDRIGRVKIQLLGFTMMTVFQLCLAIPYYKWQECNHNKYGFAVMYGLI

SEQ ID NO: 10724 - protein, 466 aa, Nostoc punctiforme
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 10725 - protein, 346 aa, Agrobacterium rhizogenes
MALVTLRQLLDHAAENGYAIPAFNVNNMEQMLAIMKAAARTDSPVIMQASRGARAFAGDATLSHLIRAAIEMYPHIPVCMHQDHGNSASTCMSAILAGFSSVMMDGSLSEDGRTPLSFDDNVAVTSKVSEMAHLVGVSVEGEIGHLGSLESGRGEAEDGHGFDGELSRDMLLTDPEEAAEFVRLTKVDALAIAIGTSHGAYKFSRKPDGDILSIKRLKEIHARLPDTHLVMHGSSSVPAELQELINAHGGDVKPTYGVPVEEIQEGIRHGVRKVNVDTDLRMAFTGAIRRVFALHPDEFDPRKYLAPGIEAMAAVCGDRYEQFGAAGHASAIKPLPLAEMAKRYSH

SEQ ID NO: 10726 - protein, 87 aa, Oryza sativa
  unsure (1)..(87): unsure at all Xaa locations
GFSCLMDDEATLGGGXKNHRRATQDLYDFIADGNFPEWKLFVQVIDPEEEERFDFDPVDDTKTWPEDEVPLXSVGRLVLNPIVYHFF

SEQ ID NO: 10727 - protein, 427 aa, Bradyrhizobium japonicum USDA 110
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 10728 - protein, 475 aa, Triticum aestivum
MAHDGASHGATTAPLLASTEKPPRNMYAFGCATLASMTTILMGYNLALMSGAQLFIREDLGLTDEQVEVLAGSMNVYMLVSILAAGWAADLLGRRGTLVLANGFLMAGALAMSLGGSYAALMAARFITSIGVGFSLVVAPVYNAEISPASARGVLSSLLDIFVNVGILLSYVSNYALAGLPVHLSWRVMYAIGVLPPVLLAAGVLAMPESPRWLAMRGREADARAVLVGTSDTAAEAELRFEEIKRVVEAPREADSGVWRELIFRPSAMVRRILVFVVGLNFLQQALGVDAILLYSPLMFKKAGMSSNSAILGATVAIGVVKTCFILVVSLFSDRFGRRPLLLASAGGVAASLTGLALTLCIGETSPASTAACVAFTLATVAAFSVGWGSLPSTYTAEITPLRLRAQGSSLGMAVNRLTCGVVSMSFISLAGWITMPGCFFLYASMAATAYVFVFLRLPETKGRTLEEMDVLFSK

SEQ ID NO: 10729 - protein, 506 aa, Photobacterium profundum
MIYAQPGTDNAVITFKSHYDNYIGGEWVKPVSGEYFDNISPVNGQMYCQVARSTEADINLALDAAHNIRATWAATSVTERSNILLKIADRIEQNLEYLAVAETWENGKPVRETLVADLPLIVDHFRYFAGCIRAQEGSAAELDQNTASYHFPEPVGVVGQIIPWNFPMLMAAWKLAPALAAGCCVVLKPAEQTPTSILVLMELVGDLLPPGVLNVVNGYGSEAGQALATSNRVAKLAFTGSTDVGHHILKCAAESLIPSTVELGGKSPNIFFADIFDHEDAYLDKCIEGMLLAFFNQGEVCTCPSRVLIHESVYDKFIAKVIERAAVIQQGNPLDTNTQVGAQASQEQFDKILGYLDIGRAEGAQVLIGGQAATLNDELDNGFYIQPTMLKGHNKMRVFQEEIFGPVIAITTFKDEAEALEIANDTEYGLGAGVWTRDANLAYRMGRNIEAGRIWVNCYHAYPAHAAFGGYKKSGIGRETHKMMLDHYQNTKNLLVSYDINPLGFF

SEQ ID NO: 10730 - protein, 281 aa, Saccharomyces cerevisiae
MSNHSEILERPETPYDITYRVGVAENKNSKFRRTMEDVHTYVKNFASRLDWGGFAVFDGHAGIQASKWCGKHLHTIIEQNILADETRDVRDVLNDSFLAIDEEINTKLVGNSGCTAAVCVLRWQLPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 10731 - protein, 170 aa, Zea mays; identical to SEQ ID NO: 2818

SEQ ID NO: 10732 - protein, 349 aa, Glycine max
MAYHHQKSLLDTLYCSEEHWIGEGEFDQAEEEYGNSNSNSSSTLVNNSPESSPHLLLESDMFWDEQELASLLEKEQHNPLSTCCLQSNPALEGARIEAVEWILKVNAHYSFSALTAVLAVNYFDRFLFSFRFQNDIKPWMTRLAAVACLSLAAKVDETHVPFLIDLQQVEESRYLFEAKTIKKMEILILSTLGWKMNPPTSLSFLDYFTRRLGLKDHLFWEFLTKSEGVLLSLIGDSRFMSYLPSVLATATMMQVLKSVEPSLEAEYKSQLFGILRIDKEKVNSCCKLMLELWSEFEGKQCMKRKFGIGWIPGSPNGVMDVSFSCDSSSNDSWVSSSPEPLSKKSRSEK

SEQ ID NO: 10733 - protein, 362 aa, Xylella fastidiosa Ann-1
MSISFDITRSLSTTSDEELSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVASAPETSLYFRPFMIATEAYLGVRAAQHASYYLIASPAGPYFAKGVAPVSIWLSTDCARAALGGTGAVKCGGNYAASLLPQQVAQTQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 10734 - protein, 690 aa, Arabidopsis thaliana
MAPRFDFSDLWAKETRRGTPVVVKMENPNYSIVEVEEPDSAFQPMEKSRGKNAKQVTWVLLLKAHKAVGCLTWVATVFWSLLGSVKRRLSFTHPLGSERLGRDGWLFSAIKLFLVASLAILAFELVAYYRGWHYFKNPNLHIPTSKLEIQSLLHLFYVGWLSLRADYIAPPIKALSKFCIVLFLVQSVDRLILCLGCLWIKFKKIKPRIDEEHFRNDDFEGSGSEYPMVLVQIPMCNEREVYEQSISAVCQLDWPKDRLLVQVLDDSDDESIQELIRDEVTKWSQKGVNIIYRHRLVRTGYKAGNLKSAMSCDYVEAYEFVAIFDADFQPNSDFLKLTVPHFKEKPELGLVQARWAFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLRSILTSKIAMWKKANLILLFFLLRKLILPFYSFTLFCVILPITMFVPEAELPIWVICYVPIFMSLLNILPAPKSFPFIVPYLLFENTMSVTKFNAMVSGLFQLGSSYEWIVTKKAGRSSESDLLALTDKESEKMPNQILRGVSDSELLEISQVEEQKKQPVSVKKTNKIFHKELALAFLLLTAAVRSLLASQGVHFYFLLFQGLTFLLVGLDLIGEQMS

SEQ ID NO: 10735 - protein, 255 aa, Triticum aestivum
RTHEDAVAATLRAGLDLDCGPFLAVYTEGAVAQRKVSDADIDAAVTNTVIVQMRLGMYDGDLATQPFGHLGPQHVCTPAHQELALEAARQSVVLLKNDGAALPLSRAAHHTVAVVGPHSQATVAMIGNYAGQPCRYTTPLQGIGRYVKTTLHQAGCTDVACQGGNQPIAAAVDAARRADATVVVVGLDQTVEADGLPLTSLLLPGRQAELVSAVAKASKGAVILVLMSGGPVDIAFAQNDRKIAGILWAGYPGQA

SEQ ID NO: 10736 - protein, 429 aa, Geobacter metallireducens
MSEITDVYAREILDSRGNPTLEVEVFLESGVMGRAAVPSGASTGEREALELRDGDKSRYLGKGVLKAVDNVNNIIAEQIIGMEATDQIGIDQRMLDLDGTEYKSNLGANAILGVSLAVAKAAAEEVGLPLYQYIGGSNAKELPLPMMNILNGGAHADNNVDIQEFMIMPAGAKSFAEALRMGAEIFHALKGVLKGKGYNTAVGDEGGFAPNLKSNEEALEVIMDAIQKAGYKPGEEVLLALDVASSELFNDGVYTLENEAEPKKTPAQMVDFYENLVNKYPIVSIEDGMAENDWDGWKLLTDRLGKRIQIVGDDLFVTNPRILKEGIQKGIANSILIKLNQIGSLTETLDAIEMAKRAGYTCVISHRSGETEDTTLADLSVAVNAGQIKTGSLCRTDRVAKYNQLLRIEDELDTTALFRGKDVFYNIRK

SEQ ID NO: 10737 - protein, 399 aa, Methanosarcina barkeri
MIMGKIFKKRTSVDEALGLFLERISTIKKTEELSLETCTGRVLAEAVISERNVPHYRRASMDGYAVKASDTMGASPSNPIMLQLSDQVEEGSLTWVHTGAAVPEGANAVVMVEDSIAAGNLVEVRAQVYPNRNVEQVGEDIKEGDVIFEKGHLLRPCDAAVLASLGLDRVKVFNKPVVAVIPTGDELVSRKRSRDVLPPGMVLETNGLMSALYVKKWGGIPRDLDIVPDNPDSIKMVIEANLDADMILLSGGTSVGKRDHGPEIVAALGELLVHGIGVIPGKPSALGVINDVPIVCLPGYPVAGFVALNFFVRPGIRKLAAIPEAPEPTLKRRLTAKVSSKIGYVSFIRVVFEGDKVRPLSGDGAGALSSVAKADGYVLVPENIEGYDEEEEVDVFLIE

SEQ ID NO: 10738 - protein, 142 aa, Chlorobium tepidum TLS
MALTLYGKDPLKMFEDVFNERLTPFISSMGSMMAPAFKVDISEDEKAIYLSADIPGVKKEDVKVSIEDDVISISAERTQEEEEKKKNYHRVERSWGSLSRSFTIGDNVDSDNITANYDNGVLKVVIPKKEPEQKKSKEIAVS

SEQ ID NO: 10739 - protein, 454 aa, Ferroplasma acidarmanus
METYGLKRILGLRSAIIINLGAIIGAGIFVIIGIAAGKAGPAIIISIFVSAIIAIFTGLSFSEIAQHTSKEGGVYEYAKESFAPSAGFIGGTMWTFSNMIAISAVSLSTGSYINSLFHLHIDLIVFGIPIIIMFAILNMLGIKNSAKTLSILVGINIAILIIFVVSGLFYFKLTDFSNFDPHGFTGIMEGSALIFFAFTGFSRITTIGDEVKNPEKNIPKAIIISIIISSALYSIVAVVAIGLIPSSNLASASAPLSAAIAVLHNSYILIIVAIGGITATAGVVLTGILGTSRVLYAMGRDREIPGTFGRIDKFGTPFYSILLSMAISLLFVYFVGFATIIEASNVSVLIAYSIIDFSAIMLWRKVKRENPKHMREQKYFFIIPLIGMATIFITISYLGLHAIEISLAVLALVSGIYGIKHVMESGGYIRKAKQIIPGYSKVRLFGRSRQQIKK

SEQ ID NO: 10740 - protein, 459 aa, Erythroclonium angustatum
DPEYVVKDTDILALFRVSPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGVISERERMDKFGRPFLGATVKPKLGLSGKNYGRVVYEGLRGGLDFLKDDENINSQPFMRWKERYLYAMEGVNRSVAATGEVKGHYLNVTAATMEHMYERAEFAKQLGSIIIMIDLVIGYSAIQTMGIWARHNDMILHLHRAGNSTYSRQKIHGMNFRVICKWMRMAGVDHIHAGTVVGKLEGDPLMIRGFYRTLLLSHLDINLPQGLFFEQDWASLRKVTPVASGGIHCGQMHQLLDYLGVDVVLQFGGGTIGHPDGIQAGATANRVALESIVLARNEGRDYVAEGPQILQDAAKTCGPLQTALDLWKDITFNYTSTDTADFVETPTANV

SEQ ID NO: 10741 - protein, 156 aa, Pisum sativum
GPFGGLKFMTGFPVKKVNTDITSITSNGGRVKCMQVWPPIGKKKFETLSYLPPLTRDQLLKEVEYLLRKGWVPCLEFELEKGFVYREHNKSPRYYDGRYWTMWKLPMFGTTDASQVLKELDEVVAAYPQAFVRIIGFDNVRQVQCISFIAHTPESY

SEQ ID NO: 10742 - protein, 48 aa, Antirrhinum majus
AVYVGENEKKRFVIPLSHLNERLFQDVLCRADEEFGFHHPMGGLTIPC

SEQ ID NO: 10743 - protein, 674 aa, Zea mays
QDFDLAAFNSGDPSKKDEAHLNAKKICHILYPGDESLEGKVLRLKQQYTLCSASLQDIIARFESRAGESLNWEDFPSKVAVQMNDTHPTLCIPELMRILMDVKGLSWSEAWSITERTVAYTNHTVLPEALEKWSLDIMQKLLPRHVEIIETIDEELINNIVSKYGTTDTELLKKKLKEMRILDNVDLPASISQLFVKPKDKKESPAKSKQKLLVKSLETIVEVEEKTELEEEAEVLSEIEEEKLESEEVEAEEESSEDELDPFVKSDPKLPRVVRMANLCVVGGHSVNGVAEIHSEIVKQDVFNSFYEMWPTKFQNKTNGVTPRRWIRFCNPALSALISKWIGSDDWVLNTDKLAELKKFADNEDLHSEWRAAKKANKMKVVSLIREKTGYIVSPDAMFDVQVKRIHEYKRQLLNILGIVYRYKKMKEMSTEERAKSFVPRVCIFGGKAFATYIQAKRIVKFITDVAATVNHDSDIGDLLKVVFVPDYNVSVAEALIPASELSQHISTAGMEASGTSNMKFAMNGCILIGTLDGANVEIREEVGEENFFLFGAEAHEIAGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 10744 - protein, 286 aa, Hordeum vulgare
MRTVELGIVAMACLVAVARAGNFFQDSEMSWGDGRGKVVDGGRGLDLTLDKTSGSGFQSKSEYLFGKIDMQIKLVPGNSAGTVTTFYLSSQGTAHDEIDFEFLGNVTGEPYTLHTNVFAQGQGQREQQFRLWFDPTKAFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGGGSWWNQELSGMGYRRMRWVQRKFMIYNYCTDPKRVAQGVPAECKLR

SEQ ID NO: 10745 - protein, 640 aa, Aspergillus kawachii
MRVSTSSIALAVSLFGKLALGLSAAEWRTQSIYFLLTDRFGRTDNSTTATCNTGDQIYCGGSWQGIINHLDYIQGMGFTAIWISPITEQLPQDTSDGEAYHGYWQQKIYYVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVEEVEPDFFPGYQEAAGVYCVGEVDNGNPALDCPYQKYLDGVLNYPIYWQLLYAFESSSGSISNLYNMIKSVASDCSDPTLLGNFIENHDNPRFASYTSDYSQAKNVLSYIFLSDGIPIVYAGEEQHYSGGDVPYNREATWLSGYDTSAELYTWIATTNAIRKLAISADSDYITYKNDPIYTDSNTIAMRKGTSGSQIITVLSNKGSSGSSYTLTLSGSGYTSGTKLIEAYTCTSVTVDSNGDIPVPMASGLPRVLLPASVVDSSSLCGGSGNTTTTTTAATSTSKATTSSSSSSAAATTSSSCTATSTTLPITFEELVTTTYGEEVYLSGSISQLGEWHTSDAVKLSADDYTSSNPEWSVTVSLPVGTTFEYKFIKVDEGGSVTWESDPNREYTVPECGSGSGETVVDTWR

SEQ ID NO: 10746 - protein, 118 aa, Lolium multiflorum
GVGHMGVKVAKSMGHHVTVISSSNKKRAEAMDDLGADAYLISSDEAQMAAAADSLDYIIDTVPVKHPLEPYLALLKMDGKLVLMGVIAEPLSFVSPMVMLGRKTITGSFIGSIEETEE

SEQ ID NO: 10747 - protein, 259 aa, Schizosaccharomyces pombe
MSRLDGKTILITGASSGIGKSTAFEIAKVAKVKLILAARRFSTVEEIAKELESKYEVSVLPLKLDVSDLKSIPGVIESLPKEFADIDVLINNAGLALGTDKVIDLNIDDAVTMITTNVLGMMAMTRAVLPIFYSKNKGDILNVGSIAGRESYVGGSVYCSTKSALAQFTSALRKETIDTRIRIMEVDPGLVETEFSVVRFHGDKQKADNVYKNSEPLTPEDIAEVILFALTRRENVVIADTLVFPSHQGGANHVYRKQA

SEQ ID NO: 10748 - protein, 383 aa, Hordeum vulgare subsp. vulgare
MNCVSNGTVYEEAVGREGRWARLCDGCCTVPSVVYCRADSAYLCASCDAQIHAANRVASRHERVLLSEAYKHAPVMLDCHADAAALCAAYEAQVHYANLLTVMHQRMPVVSHPAVAIPPVSLFAEAEATAPVLGRKEEDTSWLLLSKDSDNHNRSGNNSSTSSSSQYFGEVDQYFDLVGYNSYYDSHMSNQEQYVMQEQQHLQQMQKEYAEQQMQKEYVENEGSECIVPSQSTIVRRPHQSGYAPLVGAEQAASATAGASAYTDSVNNSISFSMEAGIVPDNTVQSSILRPAGAIGLFSSPSLQTPLHFSSKEREARVLRYKEKKKSRKFEKTTRYATRKAYAEARPRIKGRFAKRSDAEMEVDQTFSTAALSDSSYSTVPWF

SEQ ID NO: 10749 - protein, 289 aa, Hordeum vulgare
MAPRSDLLAALALALLAASVLSTGAKADFDDQFEVIGDRDHIGYRDDGNDKGQEFSLELDQESGSGFKSKAKYLFGEFQVRMKLVDGNSAGTVTSFYLTSGESATHDEIDIEFMGNSSGDPYVMNTNVWASGDGKKEHQFYLWFDPSADFHTYKITWNPKNIIFEVDGVPVRTFKKYDGLPFPSARPMTVHATLWDGSYWATQHGTVKIHWRHDPFVVPYQGYHANGCVHDKATNKTSCPAGSDAWMHRELDDGELSTVAWAERNCLSYNYCADGWRFPKGFPGECGRK

SEQ ID NO: 10750 - protein, 465 aa, Glycine max
MERRDKERLLKIRTLGNIRLIGELLKQKMVPEKIVHHIVQELLGPPDIKVCPAEENVEAICQFFNTIGKQLDESPKSRRINDMYFIRLKELSTNPQLAPRLRFMVRDVLDLRSNNWIPRREEVKAKTITEIHSEAEKNLGLRPGATASMRSNRVVSGAQGNTGPGGFPIARPGTGGLMPGMPGTRRMPGMPGIDNDNWEMPRTRSMPRGDISGIPTGGRGQSPFLSKTSTVNSKLLPQGSGGIISGRSSALVHGAGAPVRSPNLGFSAEPTPQIPSPVKAVSAIPSEKPQPPAAKLNIDELQRKTVSLLEEYFSVRLLDEALQCVEELKAPAYYPEFVKEAISLALDKSPPCVEPVANLFEYLLIKKILSARDIGTGCMLFASLLDDIGIDLPKAPNNFGEIIGKLVLAGGLDFKVVVEILKKVEDDRFQKAIFSSALQVISSVSGQAVLDSQASDIEACQSLFN

SEQ ID NO: 10751 - protein, 169 aa, Chlamydomonas reinhardtii
MSHPPPGYPGAPGYPPGYPPPAGYPPQPGYPAPAGYPPQPGYPPQPGYPPQPGYPPQPGYPPPAGYPAPGYPPQPGYPPAPHGYPPAPHGYPPQHGYPPPGAYPAPHTVVVPVAVHGAPHGAYPHGFKKHKGYKYKGHKGHYGGHYGKHKGGHYGGHYGKYKGHGKHKW

SEQ ID NO: 10752 - protein, 497 aa, Oryza sativa
  unsure (1)..(497): unsure at all Xaa locations
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGXGRTLGRPHRGPPHWXRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSFGGFMLKSAHGTQVAAEMGGHV

SEQ ID NO: 10753 - protein, 121 aa, Oryza sativa (japonica cultivar-group)
MSAAGEEDKKPAGGEGGGAHINLKVKGQDGNEVFFRIKRSTQLKKLMNAYCDRQSVDMNAIAFLFDGRRLRGEQTPDEYLRSLANHHQSITDDHCKLVQLEMEDGDEIDAMLHQTGGCLPA

SEQ ID NO: 10754 - protein, 225 aa, Shewanella oneidensis MR-1
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKPDYKAVVDEMRVELAKVEAK

SEQ ID NO: 10755 - protein, 180 aa, Schizosaccharomyces pombe
MFATRSFCLSSSLFRPAAQLLRPAGRSTLRNVWRRSIATEHLTQTEANSRLASQRVHRPNSPHLTIYEPQLTWYLSSLHRITGCVVAGTLYAFAMGYLVAPLAGYSLDTATISGLIQQVPTWIKVPAKFVISYPLTFHIFNGIRHLIWDTTKELSLKGVYRTGYAVLALSVLTSGYFAMI

SEQ ID NO: 10756 - protein, 391 aa, Methanopyrus kandleri AV19
MDRVRPLAGGRNVRIREAVLNIDPYVPGKSKEEIAREYGIEPDEIVKLGSNENPLGPSPKAVKAAKRELERLHEYPEPLAPPSLYEAIIDYLADPPYPAGEPVEITREHLVVGGDGADEIIDVLTRVLVDPGDPVVIPVPTFSQYGISARACGAEVRKPRFDPERGFELDEDSLFEALDREVRLVYLCTPNNPTGNRIRERVVRDVVEECRGVVLIDHAYVEFADHDYTPLALEYDNVLVLRTCSKALGLAGARVGYGIANPELIEHLHRIKPVFSLTRPSAAAAEATFRDRDYIEKSVRLMIESRKYLYRELRKLDRLTPFPSEANYLLVDVSNTGMNASEFTEELLKRGVIVRDCSSFEGIEPFYVRVSTGTLEEDRKFIEVVKDVLEV

SEQ ID NO: 10757 - protein, 151 aa, Lactobacillus gasseri
MFKKEGEKMFNKEEALKKLNSEQYEVTQHAATEYPFTGKYDKFNQKGIYVDVVSGEPLFSSEDKYDAGCGWPSFTKPIEKLVYHRDQSHGMERTEVKSPLADSHLGHVFTDGPVDQGGLRYCINSAALKFIPYDKLEEEGYENYQKLFKGR

SEQ ID NO: 10758 - protein, 337 aa, Monascus purpureus
MVVPKVGINGFGRIGRIVFRNAIEHEGVDIVAVNDPFIEVHYAAYMLKYDSTHGRFNGTVEFDGNTLIVNGKKIKFYAERDPAQIPWSETGAEYVVESTGVFTKQEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAVKEASEGPLKGVLGYTEDDVVSSDLNGDPHSSIFDAKAGIALNSNFVKLVSWYDNEWGYSRRVIDLIAYIAQVDAQ

SEQ ID NO: 10759 - protein, 309 aa, Synechocystis sp. WH 8501
MSIVIFGSINMDMIAQTPHLPQPGETVIGDHFITLPGGKGANQAVATAKLGRLTYFVGRVGGDSFGRELLKRLETLKINTQGVFIDQKTFSGVAMINVETSGENTIIVIPGANGNIDESDITRLEKILSKTSLLLLQLEIPLAAVEMAAREAKELGVTVMLDPAPAPEKLPDRLYPLIDIITPNQNEAEKLVGFPLDNEEEIKKAANVLLKKGVKIVVIKLGDKGAFYATDKEQDFVPAIKVKTIDTVGAGDGFNGGIAAALDRGLCLKEALKWGTIVGALTTTKEGAQTALPDLDVVHSLLLSDNSSV

SEQ ID NO: 10760 - protein, 276 aa, Hordeum vulgare subsp. vulgare
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAASRQQQLQQQQQQQQMQWEHQAQTQTHTHTQNQPQAQTSSSSSSFMMRDQQAHAPQQNICSYPPVTMGGEATAAAAAPEQQAQLRICLPPWMLSHLNA

SEQ ID NO: 10761 - protein, 366 aa, Oenococcus oeni MCW
MSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 10762 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 10763 - protein, 212 aa, Triticum turgidum
MPMSCGLCGASDCPHHMISPVLQHQEQHRLREYQFFTQGHHHHHHDAAADYPPPPPPSANCHHCRSWTTPFHETAAAGNSSRLTLEVDAGGQNMAHLLQPPARPRTTIVPFCGAAFTSTISNATIMTIDTEMMVGAAHNLTMQEREAKVMRYREKRKRRCYDKQIRYESRKAYAELRPRVNGRFVKVPEAAASSSPPASPYDPSKLHLGWFR

SEQ ID NO: 10764 - protein, 546 aa, Neurospora crassa
MAPPKFLGLSGRPLSLAVSTVATTGFLLFGYDQGVMSGIITAPAFNNFFTPTKDNSTMQGLITAIYEIGCLIGAMFVLWTGDLLGRRRNIMVGAFIMALGVIIQVTCQAGSNPFAQLFVGRVVMGIGNGMNTSTIPTYQGGVIAFGTLIAYWIDYGASYGPDDLVWRFPIAFQLLFAIFICVPMFYLPESPRWLLSHGRTQEADKVIAALRGYEIDGPETIQERNLIVDSLRASGGFGQKSTPFKALFTGGKTQHFRRLLLGSSSQFMQQVGGCNAVIYYFPILFQDSIGESHNMSMLLGGINMIVYSIFATVSWFAIERVGRRRLFLIGTVGQMLSMVIVFACLIPDDPMKARGAAVGLFTYIAFFGATWLPLPWLYPAEVNPIRTRGKANAVSTCSNWMFNFLIVMVTPIMVDKIGWGTYLFFAVMNGCFLPIIYFFYPETANRSLEEIDIIFAKGFVENMSYVTAAKELPHLTAEEIESYANKYGLVDRDSNGEGGNRHDEEKTRDRPDQSDSDSPAHVEIDVVDEHGVESGFGDGINTKETR

SEQ ID NO: 10765 - protein, 644 aa, Oryza sativa (japonica cultivar-group)
MATTAAAAAAALSAAATAKTGRKNHQRHHVLPARGRVGAAAVRCSAVSPVTPPSPAPPATPLRPWGPAEPRKGADILVEALERCGVSDVFAYPGGASMEIHQALTRSPVITNHLFRHEQGEAFAASGYARASGRVGVCVATSGPGATNLVSALADALLDSVPMVAITGQVPRRMIGTDAFQETPIVEVTRSITKHNYLVLDVEDIPRVIQEAFFLASSGRPGPVLVDIPKDIQQQMAVPVWDTSMNLPGYIARLPKPPATELLEQVLRLVGESRRPILYVGGGCSASGDELRWFVELTGIPVTTTLMGLGNFPSDDPLSLRMLGMHGTVYANYAVDKADLLLAFGVRFDDRVTGKIEAFASRAKIVHIDIDPAEIGKNKQPHVSICADVKLALQGLNALLQQSTTKTSSDFSAWHNELDQQKREFPLGYKTFGEEIPPQYAIQVLDELTKGEAIIATGVGQHQMWAAQYYTYKRPRQWLSSAGLGAMGFGLPAAAGASVANPGVTVVDIDGDGSFLMNIQELALIRIENLPVKVMVLNNQHLGMVVQLEDRFYKANRAHTYLGNPECESEIYPDFVTIAKGFNIPAVRVTKKSEVRAAIKKMLETPGPYLLDIIVPHQEHVLPMIPIGGAFKDMILDGDGRTVY

SEQ ID NO: 10766 - protein, 527 aa, Neurospora crassa
MFGGGSSSAASKSVSGSASDSGSSGKDRSSSKSPSPEKEAPGNGGASPKSIKSADQSTAGDTQIGNGSPPSAGSSSDSKKKRSSGVSGRASSLIAQAKNTLFTQVANRNSGDMSTDSKNSNQTSLQKLGKQDQALAVPQGQHNNAAGESLPGPRSTFKVGVWEDRNKKCRRTMEDTHAFLYNFLHTPAPTDNGYFAIFDGHAGTFAADWCGKKLHIILEDIIKKNPNAPIPELLDQTFTTVDTELEALPLKNSGCTAAVASATRQRVLYTANVGDARIVLCRSGKALRLSYDHKGSDENEGKRIANAGGLILNNRVNGVLAVTRALGDTYIKDLVTGHPYTTETVIQPDWDEFMIIACDGLWDVCSDQEAVDLVRDIQEPVIAAKKLVDHALSRFSTDNLSCMIVRFDKQALLENQNNKDSAIGVEGDATTAAGTVTESEKIVTATKQKIAEGSTPAVGISASNFGRGHDPTPLEDGEKKPFVPTTIEGSVEEEPVVLSDSPEATPDGSVTAMKLDSLPEAKKSLDA

SEQ ID NO: 10767 - protein, 534 aa, Oryza sativa (japonica cultivar-group)
MGGGGGEQQQLEVLHALDVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVANNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVALIDVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 10768 - protein, 363 aa, Zea mays
MRRWLCCSHFDTPYVENENGFMSSPDRTSGNGNGLNANSDPAKPPSIEIPALSFDELREKTDDFGSKALVGEGSYGRVYYAVLENEQHVAVKKLDTSADPEPDNEFLAQVSAVSRLKHEHFVDMLGYCIQGDQRLLAYEFATMGSLHDILHGRKGVAGAQPGPALDWMQRVKIAVDAAKGLEYLHEKVQPSIVHRDIRSSNILLFEDYKAKIADFNLSSQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLVNAPYQPAAAPDVSSDA

SEQ ID NO: 10769 - protein, 462 aa, Microbulbifer degradans 2-40
MQANTHHALHGQVVSVNPFTEQEVGSYALLAKNSIDRKLDQADVAFKQWRKTALDERIALIKRVATQLAENKQGLATFITIEMGKPINQAKAEIDKCIALCDYYCKNAHQFLRAKPISSNLKNSRVEFQPLGVILGVMPWNFPFWQVFRFAIPTLLAGNTVVVKHASNVFGCAEAIAKTFNQACPENTYIHLPVSSDLIPEVIAHNAVRAVSLTGSEKAGREVAQQAGHHLKKVVLELGGSDPYVVLKDADISKAAERCATSRLINNGQSCIGAKRFIVESAVARQFEELLAEHICKAKMGDPLNKSTELGPLARQDLLENLHCQVLESTSRGAEIVCGGEIPVGKGFFYEATVLTNVAKDSPAYNEELFGPVAAVIPVLDEDEAMQVANETSFGLGSAIFTADSNKAEQFAANVEAGACVINDFVRSTPELPFGGIKNSGFGRELSEFGIHEFVNIKTIAG

SEQ ID NO: 10770 - protein, 146 aa, Glycine max
KCKPNTPLNFKFFCFSDMQRKRRPMIDYMDKVQKQVTTTMRTILVDWLVEVAEEYKLLSDTLHLSVSYIDRFLSVNPVSKSRLQLLGVSSMLIAAKYEEVDPPRVDPFCNITDNTYHKAEVVKMEADMLTTLKFEMGNPTVNTFLR

SEQ ID NO: 10771 - protein, 503 aa, Ralstonia metallidurans
MLITDPQATASTGNQSGARAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPRGVYNVVHGFGPNSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCVLVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 10772 - protein, 119 aa, Bacteroides thetaiotaomicron VPI-5482
MVKANATAPAINVFETEKEYKVELAAPGMTKEDFNVRIDEDNNLVISMEKKTENKEEKKEGRYLRREFSYSKFQQTMILPDNVDKEKISAAVENGVLSVQLPKISEEEVKKAEKQIEVK

SEQ ID NO: 10773 - protein, 197 aa, Brassica rapa
MGRKKLEIKRIENKSSRQVTFSKRRSGLIEKARQLSVLCDASVALLVVSSSGKLYSFSAGDNLVRTLDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 10774 - protein, 250 aa, Glycine max; identical to SEQ ID NO: 3078

SEQ ID NO: 10775 - protein, 443 aa, Oryza sativa
MASVAVPEWLNKGDNAWQMLSATLVALQGFPGLALFYAGAVTRKCALTSAFMALYAMAATMPCWALWAHNMAFGHRLLPFVGRPAPALAQHYMLTQALLPFTAAVAPLYPSASMVFFQWASAGVTVGLVAGAVLGRMSVKAWMAFVPLWTTLSYTVGAYSIWGGGFLFHWGVMDYSGGYVVHLAAGVSGYTAAYWVGPRRKEEEEMTMAGGGNLVAMVAGAGILWMGWTGFNGGDPFSANTDSSVAVLNTHICTTTSILAWVCCDIAVRGRPSVVGAVQGMITGLVCITPAAGLVQGWAALLMGVASGTLPCYTMNAAMSFKVDDTLGILHTHAVSGVLGGVLTGVFAHPTLCDMFLPVTGSRGLVYGVRAGGVQVLKQVAAALFVAAWNVAATSIILVVVRAFVPLRMTEDELLAGDIAVHGEQAYYFSSEQELSDSPKHAL

SEQ ID NO: 10776 - protein, 404 aa, Zea mays
  unsure (1)..(404): unsure at all Xaa locations
LYSTDGPELYYISLLAGDPCDRPTGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVXALVLPQLKGKLNGIALRVPTPNVSVVDLVINTVKTGITADDVNAAFRKAAAGPLQGILEVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 10777 - protein, 96 aa, Glycine max
SDLGMFDCCGSYPLPTELRILPFFLSLHPGKMWCYCRMVYMPMSYMDGKKWTGPITPFLAAYIDQLFIKPYDENCRKIARHICANEYLYYTHHCIQ

SEQ ID NO: 10778 - protein, 840 aa, Prochlorococcus marinus subsp. marinus str. CCMP1375
MSSSQPKDLRLPTPGCYADPIKAGIDADAVFDGMTEHLFFSLGKLATTASLRDLYMALSYAVRDRLMTRYLASQEAIRAKPQKTVAYLSAEFLIGPQLNNNLLNLGITKEAEEAVGRFGIESLSHILEVEEEPGLGNGGLGRLAACYMESLASLQVPAIGYGIRYEFGIFNQLIRDGWQVEVTDKWLKGGWPWELPQPDESCFVGFGGRTESYVDEKGKYRSRWIPSEHAIGVPHDIPILGYRVNNCDRLRLWRADATESFDFYAFNIGDYYGAVEEKVASETISKVLYPNDGTDEGRRLRLKQQHFFVSCSLQDMLRSLEKRGIEVEDFSEHWTVQLNDTHPAIAVAELMRLLIDHYHFEWEKAWHITTSSVAYTNHTLLPEALEKWDLDLFSSLLPRHLDLIYEINKRFLQQVRLRYPGNDLILRKLSIIDEDGCKAVRMAHLATIGAHHVNGVAALHSDLIKRQLMPEFAELWPEKFTNITNGVTPRRWVGLANPELSSLLDKEVGKDWITNMELLKKLEQKENDSGFLELFSKTKLSGKRKLAGYIHRQTGVLVDPSSLFDVQVKRIHQYKRQHLNALQVIAQYLRIKNGVDQDIAPRTVIFGGKAAPGYFMAKLMIRFINGIADVVNADPDMDGRLRVVFLPDYNVKLGEQVYSATDLSEQISTAGKEASGTGNMKFAMNGALTIGTLDGANIEIRDRVGSENFFLFGKTESEIVELRENQYDPKTYISNCKELSEALRLVEVGHFSNGDSELFLPLINSLTGSDPFFVMADFADYLRAQDEVNKVWKNPQKWNRMALLNTARSGFFSSDRSIKEYCKSIWKVKPLDVEISCDIN

SEQ ID NO: 10779 - protein, 82 aa, Oryza sativa
  unsure (1)..(82): unsure at all Xaa locations
DPITLKVLGQDNAIVQFKIKEHPPLRKLMNAXCDRTGLSMQVVRFRFDGQPINENXLPTSLEMEEGDPIEVYHQLTGGMLLV

SEQ ID NO: 10780 - protein, 327 aa, Synechocystis sp. PCC 6803
MGIGVNSDPKVVHHQSIPKPNAMAIANYRAITTKQWQTWVEAARLQALNGKLPQYIPQLSLVDPGNFALDIGDQNGIIYEAGDTDLTFSLMSVVKPFLWLYILHHRGWQWAEQKVGDRPSHLPFNSVEQLEQDGGYPRNTMVNSGAICLAGHIPGATIEQRCENFLTWLNHTAQCQLWLDQELLASVHSLPNPRNLAIAHLLAAKGYVEDATLALETYNQLCCLSGCLKDLFKLGLMLQCPQPPLQPDTTARVKATMAKAGLYEMSEAFFRRTGFICKSGVSGLILACLPAPSPTIFACYSPPLNEEGNPVAPLALLEFLAEFTSRN

SEQ ID NO: 10781 - protein, 599 aa, Thermosynechococcus elongatus BP-1
MALMSPLFKKRAVSLGIRYNFLRLPTREKRVSTPASASLTPTGKSYRWNRERYSKTRRFFDIWFFVWRFLFGRWLLTQSWSYWGGMTDAKRAARRRAQAIWIRETFLDLGPTFIKLGQLFSTRADLFPSEYVEELSKLQDRVPAFSYELVTKIIYEDFGRPIPELFRSFDPIPMAAASLGQVHKAQLLSGEEVVVKVQRPGLRQLFDIDLAILKGIAQYFQNHPKWGQGRDWMGIYDECCRILYEEIDYLNEGRNADTFRRNFRDREWACVPRVYWRYTSRRVLTLEYLPGIKISHYEALEAAGLDRKRLAELGAKAYLYQVLNDGFFHADPHPGNIAVSPNGQLIFYDFGMMGRIQPVTRDKLLKTFLSIAQRDAEQVVQCLVELGALVPTGDLGPVRRSIQYLLDNFMNQSFETQSVAQISDDLYEIAYDQPFRFPATFTFVMRAFSTLEGVGKGLDKDFNFMQVAQPFATELMTNGNLPDPSNGSLFSELSRQAAQVGSSAIGLPRRLEEVLDKLENGDLRLRVRSSESDRILRRLSNINLGLNYVVLIGSFSLAATILFVNQYLLLAGVAAALAVWFGILYWRLMLKLDKYEKMF

SEQ ID NO: 10782 - protein, 270 aa, Chlamydia muridarum
MLTDKKSSPTWSSLLPSETSQYFVFGNWKMNKTFSEAQTFLKDFVSCEILSNPKIITGIIPPFTLLSSCQQIIKNTPIRLGAQTLHEVDSGAFTGEISAPMLKDIGVDFVLIGHSERRHIFHEQNHSLAEKLLAAIRNGIVPVLCIGETLEEQEAGATQDILLEQLTVGLSRLPEHAPFILAYEPVWAIGTGKVANPDLVQEIHAFCRNVVKDLISKDAAERTPILYGGSVKADNTRALTLCPDVNGLLVGGASLSVESFLAIIQQIAVS

SEQ ID NO: 10783 - protein, 433 aa, Prochlorococcus marinus subsp. pastoris str. CCMP1378
MSNGFYKNRRLKSFLFLAVCLLVSTIPHIFQYKYFLFFTITISFLVACYGLNVISKNIKRSVSSQSNEKIISNDKLPALDILVAARDEENVIERLVERLFDLDYPINKLNIYIIDDGSSDKTPLILERLSKEFDKLKIITRSANAGGGKSGALNYALKFTHGEWLLILDADAQLKNDTLPRLFRFVYAGSWSAVQLRKSVINVSKNFLTTCQSMEMAMDAIFQYGRLSVAGVSELRGNGQLINKEVLLKCGSFNEDTVTDDLDLSLRLLLSKSKIGILWDPPVMEEAVENISALFSQRQRWAEGGLQRFFDYGEQLFSKKIELIQKFDLTFFFILQYALPIISLVDLILSIALTESPSYWPISITAFTLSGIAVWYGSSCKSEGPVLQNLNLMMMLVSLVYLSHWFLVIPWVTIKMSLFPKKILWKKTLHTGV

SEQ ID NO: 10784 - protein, 323 aa, Candidatus Blochmannia floridanus
MNQLDNLKKFSKISADTGDVDLIRTYQIQHATTNPSLILKSPLFTTYLKLFNDAIDYAQKIGGNQNTKITNASDRLIVNIGSEILANISGYISTEIDAQLSFNTDLTIKKAHKLITMYQKKNIDTSRVLIKIAATWEGIQAAEELEKSGIKCNLTLVFSFAQARACAERNIYLISPFIGRIYDWYNQRNLIKTSYINDDPGIQSIKKIYHYYKTYGYNTIIMGASFRRLEQILALSGCDYLTISPHFLKQLYQNTNSVTRQLFPPKTIISHHIPVLDQSEFFQEHNKNQMAVEKLNEGIQQFSIDQQKLHKLLLNNLNVQLQK

SEQ ID NO: 10785 - protein, 477 aa, Chondrus yendoi
KNERYESGVIPYAKMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGRIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLQQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANV

SEQ ID NO: 10786 - protein, 377 aa, Burkholderia fungorum
MTRLATSATCVAHRRRLTISPSLLELPMSTTYAYAATDATAPLAPFEIQRRELRAHDVQMEVLFCGVCHSDLHQARNEWKNTVFPVVPGHEIVGRVTAVGPDVTKHKVGDLVGVGCLVDSCRTCASCEEGLEQYCENGFVGTYNGVDRVDGQITYGGYSTQLVVDEEFTLSVPDNLDPAGVAPLLCAGITTYSPLRTWGAGPGKKVGIVGLGGLGHMGVKLAHAMGAHVVLFTTSPSKIEDAKRLGAHEVVISKNAAEMEAHLNSFDFILNTVAAQHDLNPFLNLLKRDGTMTLVGAPEHDHPSPQVFNLIFKRRRLAGSLIGGIAETQEMLDFCGEHGITSDIEVIPMQGINEAYERMLKSDVKYRFVIDLDSLRK

SEQ ID NO: 10787 - protein, 765 aa, Escherichia coli O157:H7 EDL933
MKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSIMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITILQSQRDLIAALKATGKPLVLVLMNGRPLALVKEBQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 10788 - protein, 92 aa, Bixa orellana
EQDRYMPIANVIRIMRKVLPTHAKISDEAKETIQECVSEFISFITSEANERCQREQRKTITAEDVLFAMSRLGFDDYVDPLSIYLQRYREFE

SEQ ID NO: 10789 - protein, 473 aa, Chloroflexus aurantiacus
MTMDAKGVIELIKAKGIQIVDTRFTDLFGGWQHYSLPASRLTEDMIREGLGFDGSSIKGFQAINESDMLMVPDPSTAFIDPTLSVPTLVLICDIIDPITRQPYSRDPRTVAKKAEAYLKTTGIADTAYFGPEAEFFLFSDVRFGQGANHGFYYIDSPEAVWNTGAEIPGGNKGYRIRHKEGYFPVPPTDTLQDIRSEMILKMMEIGIEIELHHHEVATAGQCEIDMRFDSLVNMADKVQKYKYIVRNVARAHGYSATFMPKPIFGDNGSGMHTHQSLWKDGEPLFFDETQYALLSKTAQYYIGGILKHAPALLAICAPTTNSYRRLVPGFEAPINLVYSMRNRSAAIRIPTYSSSPKARRIEFRAPDAMCNPYLAFAAMMLAGLDGIQNKIEPPPPLDVDIYELSPEEKGDIRSTPGSLTEALDALEQDYHFLLKGNVFTTDLLETYIETKRKEAVGLSLRPHPYEFMMYYDA

SEQ ID NO: 10790 - protein, 320 aa, Zea mays
MGILALITGKAGASGFGSASTAEQVTDGADASRLTVAITGGASGIGLETSRVFALRGAHVVIAARNTEAASEARKTIMEKNPTARIDVLKLDLSSLKSVRAFVDRFNSMKLPLNILINNAGVMFCPFQLSKDGVEMQFATNHLGHFLLTNLLLDTMKATAKSTGIEGRIVNLSSVAHHHTYPKGIDFDNLNDEKKYNDKMAYGQSKLANLLHAKELSRRLKEEGENITVNSVHPGLIMTNLMRHSFVLMKVLQVATYILWKNVPQGAATTCYVGLSPQLKGVTGKYFADCNVEKTSKLARSEELAKQLWDFSEELIKSAK

SEQ ID NO: 10791 - protein, 223 aa, Vibrio cholerae
AGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSTTLSMGQAACRFGLALVKALQGESDV

SEQ ID NO: 10792 - protein, 237 aa, Zea mays
  unsure (1)..(237): unsure at all Xaa locations
MATCATTLAPLLGPAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGKLLFGSGIIDFAGSSVVHMVGXASPGLWGALIEGPRIGRFDTPGRSXALRGHSASLV

SEQ ID NO: 10793 - protein, 218 aa, Streptococcus pneumoniae TIGR4
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTSVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 10794 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSTFEQHSLDAMLDTL

SEQ ID NO: 10795 - protein, 172 aa, Lactobacillus delbrueckii subsp. lactis
  unsure (1)..(172): unsure at all Xaa locations
KSKRAIEDHFDSNPEXEDNLTEKHKDALLKLVRETTMSNTKVNLYFTRQPHPNGLGDAVNRARSFIAGXPFVVMLGDDLMRDKTPLTKQLIDCYDETHASTIAVMKVPHEEVNKYGVIDPIGETAPDLYNVKAFVEKPDIDKAPSDLAIIGRYLLTPEIFDMLDKQKAGAGG

SEQ ID NO: 10796 - protein, 235 aa, Pisum sativum
SKMRAILIDWLVDVHTKFELSPEALYLTINIIDRFLAISLVSRRELQLVGISAMLMASKYEEIWPPEVNDFVCLSDRAYTHEQILIMEKTILGKLEWTLTVPTPFVFLVRFLKAASVSLPSSDLALENMAHFLSELGMMHYATLMYSPSMMAAAAVYAARCTLNKSPVWDETLTMHTGYSEEELMGCARLLVSFHSASGSGKLKGVYKKYADPQKGAVAVLPPAKNLVSSAAVGS

SEQ ID NO: 10797 - protein, 168 aa, Zea mays
MFDSAPAAGRVDEEEWVTVFGFFPGDTNMVLREFEKCGIVLRHVLGPRDANWVHILYQSRHDAQKALAKHGQQLNSVLIIGVKPVDPWQLQYLNENTNENYQGSARATFTSQPVAPSGFATRNALAPLPSNTLTNGSCNDSSNLGASGAVASPTKSVLSKVMDLMFGL

SEQ ID NO: 10798 - protein, 157 aa, Triticum aestivum
  unsure (1)..(157): unsure at all Xaa locations
MAPTVMASSATSVAPFQGLKSTAGLPVSRRSNGASLGSVSNGGRIRCMQVXWPIRGHQEFRDLSYLPPLNTXGLLKQVDYLXFRSKWVPCSXFNKVGFIFXEHNQSPGXYYDGRYWTIWXLLFPGAPTHTGXNEVEESKKDTCPYSSFRQIPCSVMP

SEQ ID NO: 10799 - protein, 747 aa, Xanthomonas campestris pv. campestris str. ATCC 33913
MKTFTPAAPRPRRLALALALGLGIALSAPLAAQQASAAQPWMDTALSPDQRAALLLTQMTDDEKFQMLRSYFGLGTEKIPKPEGALGSAGYVPGIARLGIPAQQLADAGVGVTNPGGIRKGDFATAMPSGPSTASSWNPQLAYAGGKTMGRESWQQGFNVLLAGSVNLQRDPRNGRNFEYAGEDPLLAGVMVGESIRGVQSEHVLSTMKHFALNDMETRRNFHSAQIGEQAMHESDLLAFEIALKIGDPASVMCSYNKINGIYGCEHDYLLNQVLKQEWKYPGYVMSDWGGVHSGSKAALAGLDQQSAGEVFDAAVFFDAPLRMAVGAGVVPRARFDDMVTRILRSLFAHGAFDHPTQRQPIDGKAGQRAAQRVAEEGSVLLRNEQATLPLSKDVRRIAVIGGYADKGVMSGGGSSRVDYTINGGNAVPGLTPTTWPGPVIIHPSSPLQALRAALPDVQIDYVDGKDRAAAARAAKAADVAIVFATQWAAESVDLPDMQLPDGQDALIEAVAKANPKTTVVLETNGPVRMPWAEHVPAVLQAWYPGIGGGEAIANLLTGAVNPSGHLPVTWPVDESQLPRPSIPGLGFKPAKPGEDTIDYAIEGANVGYKWFAARNLTPRYPFGHGLSYTQFRMGGLRVEAANGQLTANFEVENTGQRDGAAVPQLYVTLPNGHATPLRLIGWQKVALKPGEKHTVQVVAEPKTLADFDAKARHWTIAAGTYRVQLARSATDPVESVEVALPAMQLP

SEQ ID NO: 10800 - protein, 204 aa, Chloranthus spicatus
LCDAEVALIVFSNRGKLYEFCSSSSMLKTLERYQKCNYGAPDTTVSTREMQSSQQEYLKLKARVEALQRSQRNFLGEDLGPLSGKELEQLERQLDMSLKQIRSTRTQYMLDQLTDLQRREQMLCETNKALKRRLDEVTPANPHQGWDPNPHGVSYGRQAAQQQGDGFFHPLECEPTLQIGYQHDQITIAAPGPSVSNYMPGWLA

SEQ ID NO: 10801 - protein, 469 aa, Pterocladia lucida
  unsure (1)..(469): unsure at all Xaa locations
VIPYAKMGYWDPDYIVKDTDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIASAGEIKGHYMNVTASTMEEMYERAEFAKQIGTIIIMIDLVIGYTAIQTMAIWARRNDMILHLHRAGNSTYSRQKIHGMNFRVICXWMRMAGVDHIXAGTVVGKLEGDPLMIKGFYNTLLLTHLEVNLPQGIFFEQDWASLRKVTPVASGGIHCGQMHQLLDYLGIDVVLQFGGGTIGHPDGIQAGATANRVALEAMVIARNEGYDFVAEGPQILRDAAKTCGPLQTALDLWKDITFNYTSTDTADFVETPTANV

SEQ ID NO: 10802 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 10803 - protein, 493 aa, Triticum aestivum
  unsure (1)..(493): unsure at all Xaa locations
MDVPLASKTFPSPSPSXRQQCNVDGHKSSSKHADLNSHANDSVLGIILGGCAGTRXLYPLTKKRAKGAVPLGANIRLLDIPVXNCLNSNIXSIHVLTQFNSAFSFNHSSPSATLEGSNIGXGYKEMNGFGLKILVCTARAQMNPDWFXGTADAVXRQYLWLWEEHNVXEYLILAXGDHLYRMXYEKFIQAHXETDADIXVAALPMDEEXRATAFGLMKIDEEGXIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQXPRHLPPSKVLDADVTDSVIXGEGCVIKNCKIHHSVVGLPDPAYLKGAIXIKDTLLMGADYXETEAXDKKLLAEKXGGIPIGIWKEXSHIKRAIIDKNARIGDNVIDNQWLTMVQESGQGRTDGYFIKSGIVTXIKDALLPSGTVI

SEQ ID NO: 10804 - protein, 486 aa, Novosphingobium aromaticivorans
MRERIDIAGIPVSPDHFIGGKRVSSPYTFETRCPFDWSWKLADISRGTVTTAAQAAQAATDAFPAWAALSAAERGAYLHRLADLIEANVEKLAMIECLDMGMLLESLRLRVILRGAANFRNYADLATGHEERVWSSRGTLNRVIRMPAGPALIITPWNAPFMLSTWKCAPALAAGNTVILKPADWSPLSASILADLIEEAGFPAGVFNIVQGLGAELGNALTSDPRIKRISFTGSVPTARVIGKAAAENIVPLTAELGGKSPLLVFADADIDAAAKKAAGQYDDSGQVCMAGTRIIVEESVKDEFLAKFHAYADAHVMGDSRDAATTMSALIHPVHVERVLGFIERARAAGDAIVRGGRLWKEGSNWIEPTLIEPKNNQSEVVQSEVFGPVLTFQTFRDEAEGVALANSTAYGLSGIVYTGSAERAERVGRQVRGGTVWVNTFLVRDLTAPFGGIGISGIGREGGDYALDFHSDLKTLQILEGSVV

SEQ ID NO: 10805 - protein, 332 aa, Streptomyces coelicolor A3(2)
MDTFALVVTIGVALFFTYTNGFHDSANAIATSVSTRALTPRAALAMAAVMNLAGAFMGSGVAKTVSEGVIETPEGSKGMGILFAALVGAIVWNLITWYFGLPSSSSHALFGGMVGAALAGSTTVYWHGVVDKIVIPMFVSPVIGLLAGYLVMTAIMWIFRRANPHKAKRGFRIAQTVSAAGMALGHGLQDAQKTMGIVVMALVIADVEDYGDPIPVWVKLACALMLSLGTYAGGWRIMRTLGRKIIELDPPQGFAAETTGASIMFGSAFIFHAPISTTHVITSAIMGVGATRRVNAVRWGVAKNIIMGWFITMPAAAVVAAVSFWIVNLAVL

SEQ ID NO: 10806 - protein, 135 aa, Haemophilus influenzae
EDPTPALEGADVVLISAGVARKPGMDRSDLFNINAGIVRGLIEKVATTCPKACVGIITNPVNTTVAIAAEVLKKSGVYDKRKLFGVTTLDVLRSETFVAELKGLNVSRTSVPVIGGHSGVTILPLLSQVQYAEWN

SEQ ID NO: 10807 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 10808 - protein, 302 aa, Akashiwo sanguinea
RIGRNVLRCWLKRETKPFDIVAINAGSMSAQTTAHLLKYDTVLGTLDAEVTYTDDALTIDGKEIKLLSGRDPAAMPWKDMGVEVIIESTGAFNSLDGGAKHLEAGAKKVVLTAPGKNCPTYVVGVNEGDYDAENDTVVSNASCTTNGMASVCKVLDDSFGVEYGLMTTTHSYTGDQMILDGRHRDLRRARAGACNIVPTSTGAAKAVAAVLPKYKGKLNGIALRVPTPNVSIVDLVVKVSKKCTTEEVNAAVKAAADGPMKGIINFEEQPLVSSDFKGTDYSNSVDAALTMVMGEDLVKVVM

SEQ ID NO: 10809 - protein, 138 aa, Glycine max
  unsure (1)..(138): unsure at all Xaa locations
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 10810 - protein, 394 aa, Xanthomonas axonopodis pv. citri str. 306
MDSLLQYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGRHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIALFEARRAEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 10811 - protein, 1342 aa, Oryza sativa
MRFGTYEASYDNLPRLLGVIEGRNPGSSYAVKKFPSIEHPGKSVLQRVFLALHACKMAFVNCRPVLCIDGTFLTGKYRGQILTAIGVDGNNQVLLLAFAFVESENTDSWYWFLKLVKTKVISMRPNVCLIHDRHAGILRAIEELQFGSMERGYPGEWEDVQSRWCMRHMGANFFKQFKNKELMNMFKRLCNQNQEKKFNEFWKRLDELTAKCSDQRAAAPSTAVADPPQALGPLPMDSPTLVRRTGVEIRKFSQWILHEPKEKWAKAYDTSGARYGIMTTNLAEVYNWVMRGVHGLPLVGIVEFILHGTCRYFRDRFQAVLPSMLNNSILFGTFMQKKLEELRIKAMKHRALVQGTQQHRFEILCQDKAGRGIYRKRVKQECVLKADGTCHCSCAKPKLLHRPCTHVIAVATKCGIPDAVYVSQYFSKQAVYHTWSGKIYGFGIAGEFTETNDEGAQLGTFQARTCGDLLTVHDSFVERLREAGLLPMCRLVEDDAGNADPARRWNVDRSLLADLVDRWRPETHTFHLPCGEVEQLQAEADEYSYSRCLEAYLLCLFGWVYTKTDPSATFGGCPLFLSIWAAERIAIGRPEVDQHAYEESLCAERPEVDYPTMGTLWCRRQVKRSYPEFVMEFDRLQPTDVVWEPYSATATQARVPLGMSTLCTRDQAYWMTTVPMVFDICVEPHAPFRVMRQFGFRQPFPVPFPTTVPAAVHRYSRKGQQSAGNWPAKLVTFVEDWLLATEEVVDHEGEPHTEEAYQGYLRWYQPRTRTRVTFAPLEQQAHVASTRELYARHRDQDFARAVDDINRVVVDGSMTIQRLGAGIPTTLLGQTQLYSGYPYRLVPVQLRTFLGRLPLRMEGFVHHSAPRLPRLGLLLCPPQVLRSIKPTTLGRRFFVCPNILDDDFMEPPRRCQYREWIDTIRVLTPPSRVVQLELPEQYRWGGKGPKCKKYEPQALYGLLKLHLAPCCPRDAAKIVRRPKITTVVAQQPPGIRRALADVSNLVNGRAALPVVNRQKAPAAADKCRKPIKQRNENNKAKPEVIVISSDSEKQKKSPAQRAASRRAPIQTLTSILTKCSRASGGVISPKKELIYDIDASDAHNELAVIDYVEDIYRFYRSTENTYRPLCTYMVSQTEINERMRAILTDWLIEVHYRLMLMPETLYLTVYIIDQYLSLENVARNELQLVGVSAMLIACKYEETWAPLLAIVFSAAQFAYDVQLAIMFNAVQFAHDFKDFLVISDNSFSRQQVLSTEKSILNKLQWNLTVPTMYMFILRYLKAALGDKELEHMTSVIAAAAVYAARCTLGPCPEPTMERSSGVPHRLSRATIAVCLLLHDLIFAHEI

SEQ ID NO: 10812 - protein, 215 aa, Aspergillus oryzae
MSSTSPSKEPEVEPEVQSGEEQEQMDKEQQDQAQNQGEFEVKEQDRWLPIANVARIMKLALPDNAKIAKEAKECMQECVSEFISFITSEASEKCQQEKRKTVNGEDILFAMTSLGFENYAEALKIYLSKYRETQSARGEHQNRPTSSGYASGGPVGGVSSAPGGRPATAGGFPDAADNTNSIMNPSLDPTEQDPSAYGYPPMVGQPHNGTAGDSY

SEQ ID NO: 10813 - protein, 312 aa, Dermocarpa sp.
NGFGRIGRLVARIMIEDPNSKLLAINTGADANYMAYQFKYDTVHGKWKGSLEVDGDDLIINGQRVKTTHFRNPNEIPWKGLGVEYLCEPTGVFLTADSAKPHVDSGVKKVIFSAPAKDKSPTIVMGVNENEYTTDMTFVSLNASCTTNCLAPMVKAIHDKFGIEDALMTTVHAMTSTQMVVDGSSKKDWRGGRGAAQNIIPSSTGAAKAVAQVILPSKGKITGMAFRVPTADVSVVDLTLRLATETTYEEICAEIQRRANTDMKGILGYTDEALVSSDFVTCPISSVFDAKAGIMLNPRFVKLVAWYDNEWG

SEQ ID NO: 10814 - protein, 318 aa, Saccharomyces cerevisiae
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 10815 - protein, 222 aa, Zea mays
  unsure (1)..(222): unsure at all Xaa locations
MAGLSLEHPWAFAFGLLGNVISFMTFLAPIPTFYRIYKSKSTEGFQSVPYVVALFSAMLWIFYALIKSNETFLITINAAGCVIETIYIVMYFVYAPKKAKLFTAKIMALVNGGVFGVILLLTLLLFKGSKRRXLLGWICVGFSVSVFVAPLSIMRRVIQTRSVEYMPFSLSLSLTLSAVVWFLYGLLIQDKYPTLPNDLDIIFQVIQMELYVPYMNKKQAAG

SEQ ID NO: 10816 - protein, 234 aa, Glycine max
  unsure (1)..(234): unsure at all Xaa locations
MDWNLKAPSWDLVDHVDKATTLQQNIGTKAAPYAPPPYRMKGEFSVDLKLGHHHVGNSGTESALANKSKDAAAASGAAASAGVSKMASSPSGSSKRARTISSTSLTVSCLVDGCNSDLSNCRDYHRRHKVCELHSKTPEVTIAGLKQRFCQQCSRFHSLEQFDERKRSCRKRLDGHNRRRRKPQPEPLSRPGSFWSNYQGTQWLPFSGPHVYASTXMVSPDGSGALVTSSADAR

SEQ ID NO: 10817 - protein, 333 aa, Thermosynechococcus elongatus BP-1
MTALWQRLILISPFFFWGTAMVAMKEVMPHTSPLWIAGVRLVPAGLLVLGVAIALGKPQPNTLGAWGWISLFALVDGFLFQGLLATGLSKTGAGLGSVMIDSQPLAVALLSRWLYQERVGGWGWLGLLLGLGGISAIGLGDDLLPLLHQPSAWQGIPWGQWWQRGELWMLLAALSMAVGTILMRPLARYADPVVATGWHMVLGGLPLLIWPSLNTPAPWAALQWSDVLNLGYATLFGSALSYGVFFYFAAKGNLTSLSALTFLTPVFALTFGHWFLGETLSQVQLLGVGLTLVSIYIINQRQVLGQWWQQLPLPTRLRESATSVSVKVVDEMK

SEQ ID NO: 10818 - protein, 260 aa, Shewanella oneidensis MR-1
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 10819 - protein, 335 aa, Mycoplasma hominis
MKKTRIAINGFGRIGRLIFREIFNDPEFEIVAINDLTDAATLAHLLKYDTAHGKMNENIWHTENSIVVNGKEYRVYSEKDPLNLPWKELNVDIVIEGTGRYVTKEGAELHIQAGAKKVFITAPAKSEGVKTVVYSVNEDIITPEDKILSGASCTTNCLAPIANVLEKNFGIEKGFMTTVHSYTADQRLQDAPHKDLRRARAAASNMVPTTTGAAIAIGKVIPSLDKKLNGLSLRVPTITGSFVDLTVELKKDATVQEINEAMKKSASESLEYSTEPIVSSDIIGAKAGSIFDSLLTSVLEVEGKKLYKVYAWYDNESSFVAQYVRTLRHIGKLTK

SEQ ID NO: 10820 - protein, 250 aa, Zea mays; identical to SEQ ID NO: 369

SEQ ID NO: 10821 - protein, 171 aa, Zea mays
  unsure (1)..(171): unsure at all Xaa locations
DEATVDSGSKALQFLGLHDQDSTVPPVHTHQLDVAGNQDVAVNLIITDYCMPGMTGYDLLKKIKESSSLRDIPVVXIMSSENIPSRINRCLEEGADEFFLKPVRLSDMNKLKPHILKSRCNQEQHQQSDSHSGERRNPTIGSSSDSINNRKRKGAGTEEILPQLANRSRHS

SEQ ID NO: 10822 - protein, 415 aa, Colwellia maris
MTNKIIIPTTGDKITFIDGKLSVPNNPIIPYIEGDGIGVDVTPPMLKVVNAAVAKAYGGDRKIEWLEVYAGEKATKMYDSETWLPEETLNILQEYKVSIKGPLTTPVGGGMSSLNVAIRQMLDLYVCQRPVQWFTGVPSPVKRPSEVDMVIFRENTEDIYAGIEYKAGSDKAKSVIKFLIEEMGASNIRFTENCGIGIKPVSKEGSQRLVRQAIQYAIDNNKDSVTLVHKGNIMKFTEGAFKDWGYELAIEEFGASLLHGGPWCSLKNPNTGKEIIIKDVIADAMLQQVLLRPAEYSVIATLNLNGDYLSDALAAQVGGIGIAPGANLGDEVAVFEATHGTAPKYAGKNKVNPGSVILSAEMMLRHMGWLEADLLLKGMSGAIQAKTVTYDFERLMDDATLVSCSAFGDCIIDHM

SEQ ID NO: 10823 - protein, 213 aa, Candida maltosa
DQSLNILLAGRDTTAGLLSFAVFELGRNPEVWSKLRQEIGDKFGLDSDSRIEDISFELLKLCEYLKAVINETLRLYPSVPRNGRFAAADTTLPHGGGKDGMSPILVRKGQTVMYSVYALQRDEKYYGKDANEFRPERWFEPEVRKLGWAFLPFNGGPRICLGQQFALTEASYVLVRLIQSFETLELSPEAAYPPAKLTHLTMCLFDGAPVRIE

SEQ ID NO: 10824 - protein, 124 aa, Triticum aestivum
RGASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQ

SEQ ID NO: 10825 - protein, 542 aa, Leuconostoc mesenteroides subsp. mesenteroides ATCC 8293
MTTTGYSILRNPFLNKGTAFSAAEREQLGLTGTLPSQVQMIEEQAEQAYKQFQAKSPLLEKRTFLMNLFNENVTLFYHLMDQHVSEFMPIVYDPIVAESIEQYNEIYTNPQNAAFLSIDHPENIESSLKSVADGRDIKLVVVTDAEGILGMGDWGVNGVDIAVGKLMVYTAAAGIDPATVLPVSIDAGTNNKILLENPLYLGNKHERIAGEKYLEFIDKFVTAEQKLFPASLLHWEDFGRSNAQVILDKYKDSIATFNDDIQGTGMIVLAGIFGALNISKEKLVDQRFLTFGAGTAGMGIVNQIFSELKQAGLSDAEARSHFYLVDKQGLLFDDTEDLTEAQKAFTRSRKELVNSEQLDNLEAVVNEIRPTVLIGTSTQPGTFTEAIVKSMAQNTERPIIFPLSNPTKLAEATAENLIKWTDGKALIATGIPAANVTYKGVTYKIGQGNNALIYPGLGFGLVASTAKLLTQETISAAIHALGGLVDADEPGAAVLPPVSNLTEFSQKIAEITAQSVLKQGLNREKIADPKQAVQDAKWSAEY

SEQ ID NO: 10826 - protein, 374 aa, Triticum aestivum
  unsure (1)..(374): unsure at all Xaa locations
TRLRAAARSTSDVKPEEFAMLVRDVPVPPPNQTIKDSVDSYFRALHPDTFYKAMVVTDITKADQIFQEIEGHRHKIAHAEAVYAESKTSNRPEGTRPTHRTGFLGLIGKKVDTLEYCNEKIKELLPKLEDEQKSTLSEKQQRAAFVFFNSRAAAASASQTLHAQMFDEWTVTEAPEPRAVIWTNLPRKIYDRQTRQTVVYLIVFVTVVFYMIPITAISAVTTLEQLRKKLPFLKXVVDQPLLKTVLQAYLPQIALIVFLALLPTLLVFLSKSEGIPSQSHVVRASSGKYFYFIVFNVFIGYAIGSSLFSALQKVIENPTXIVTTLGSRLPGNATFFLTFVALKFFVGYGLELSRLVPLINFXLKRNYYARQRMR

SEQ ID NO: 10827 - protein, 276 aa, Arabidopsis thaliana
NLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 10828 - protein, 257 aa, Oryza sativa
MEERLADVEGSFACNSRGEDDFRSCCGDEDEWEDTEESFTAGVAKGELDESSVRLFFKGVSSPEAEGKKLSGIGVVMERSPGVPMLQVQKKLDFYVDELVADHLALMDGLLVALQNGIRKIFAFTNSEKLCGHEFCYSCGAEYTNGIQTCQCVFWDEESIEAASAAHSTQASEIWAWDTFDCMPTAIEGYSEQERAQLALIQRFLSGGFNLGEPPSQSPPRCADSYIIDTMKDLHQLPWLERFVSVISDSYNEDYIQ

SEQ ID NO: 10829 - protein, 129 aa, Chaetosphaeridium globosum
MKINRPLSPHLTVYKPQLTSTLSIFHRISGAFLAFFVLSFALSMPICQINLSFYSFYKIWFYLCHDKLWVFLTVLNLAFFSVCYHMSNGIRHLLWDYGLFLDLSKVYFSGVFMLIVAVSLVILNLIRII

SEQ ID NO: 10830 - protein, 331 aa, Zea mays
  unsure (1)..(331): unsure at all Xaa locations
MLLLLFFSVLAAVAAFLLFKFATVVDGDLTLVSRGPPLRERVDGKVVWITGASRGIGEVLAMHFANLGAKLILSARNKDALARVKKNILSKNPDSRVEMLPMDLSAGEESLKEVVHVAESFFSNAGVDYMVHNAAFERPKRRALEESEEGLKATLNVNVFGTITLTRLLAPYMLDRGMGHFVVMSSAAGKVPAPGQAIYSASKHALNGYFASLRSELCTKGIKVTVICPGPIETLQSSAAASSSQTHSAEKREKRVSVERCVELTIVAATHGLKEAWISYQPVLTVMYLVQYMPTIGYWLMDKVGAKRLDXAAKKGNTYSWSLIFSSKKSA

SEQ ID NO: 10831 - protein, 233 aa, Glycine max
NSRVVLFISKTVADAFNANIYDIIMKAKGLPYLETHAEPYMRQLSVGDVVTGPLQTFNGVEKVCNIVFILRTTGHNGFPVIDEPPISQAPVLFGIILRDHLLTLLKKKAFMSSPMATSGDVINEFSADDFAKKGSSKGRLKIEDIQLSEEEMDMFIDLHPFTNASPYTVVETMSLGKALTLFRELGLRHLLVVPKFSGRSPVVGILTRHDFMSEHILGLHPFLVRNTGKSLRF

SEQ ID NO: 10832 - protein, 449 aa, Mazzaella volans
  unsure (1)..(449): unsure at all Xaa locations
VLALFRVSPQPGVDPVEASAAVAGESSTATWTVVWTDLLTACDLYRAKAYKVDTVPNTTDQYFAYIAYDIDLFEEGSIANLTASIIGNVFGXKALKALRLEDMRLPVAYLKTFQGPATGVSCERERMDKFGRPFLGATVKPKLGLSGKNYGRVVYEGLKGGLDFLKDDENINSQPFMRWKERYLYSMEGVNRAIAAAGETKGHYLNVTAATMEQMYERAEFAKELGSIIVMIDLVIGYTAIQSMAVWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALESMVIARNEGRDYVAEGPQILXXAAKTCATLQTALDLWKNITFNYTSTDTADFVETPTANV

SEQ ID NO: 10833 - protein, 459 aa, Gelidiella acerosa
DPDYQVKETDVLALFRVSPQPGVDPVEASAAVAGESSTATWTVVWTDLLTACDLYRAKAYKVVEVPNATDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTIIIMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADYVETPTANV

SEQ ID NO: 10834 - protein, 555 aa, Torenia hybrida
MGFESVIKLAASETDNLWSSGHGSVVAITLFVTLLCTCIVIGHLLEENRWMNESIIALIIGLATGVIILLISGGKSSHLLVFSEDLFFIYALPPIIFNAGFQVKKKSFFRNFATIMMFGAVGTLISFIIISLGTIAFFPKMNMRLGVGDYLAIGAIFAATDSVCTLQVLSQDETPLLYSLVFGEGVVNDATSVVLFNAVQNFDLPHMSTAKAFELVGNFFYLFATSTVLGVLTGLLSAYIIKKLYFGRHSTDREVAIMILMAYLSYMLAELFDLSGILTVFFCGIVMSHYTWHNVTENSRVTTKHTFATLSFVAEIFIFLYVGMDALDIEKWRFVSGSMTTSAAVSATLLGLVLLSRAAFVFPLSFLSNLAKKSPLEKISLRQQIIIWWAGLMRGAVSMALAYKQFTREGLTVERENAIFITSTITIVLFSTVVFGLMTKPLINLLIPSPKLNRSVSSEPLTPNSITIPLLGESQDSVAELFSIRGQTSQGGEPVARPSSLRMLLTKPTHTVHYYWRKFDNAFMRPVFGGRGFVPYVPGSPTERSVRNWEEETKQ

SEQ ID NO: 10835 - protein, 326 aa, Zea mays
MSFSAARVSEHGGEFEEARGMPAEVSWEMLDKSRFFVLGAALFSGVSAALYPAVVLKTHLQVAAPAQAAASAAAAAILRRDGPRGFYRGFGASLAGTVPARALYMAALEATKSVVGSAALRLGVAEPAASAAASAAGGVSAAVAAQVVWTPVDVVSQRLMLQTAPLAAARYRGGTDAFRKILLADGVRGLYRGFGISVLTYAPSSAAWWASYVTAQRLLWRAVGPAAHDSRGAAIALQGASAAAAGSAAALVTMPLDTVKTRLQVMDAGAQAPTLAAAARALVREGGWSACYRGFGPRWASMSLSSATMVTVYEFLKRLSAKEGSL

SEQ ID NO: 10836 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRAIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 10837 - protein, 174 aa, Triticum aestivum
MAPAVMASSATTVAPFQGLKSTAGLPVSRRSRGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 10838 - protein, 452 aa, Gymnogongrus griffithsiae
  unsure (1)..(452): unsure at all Xaa locations
KARXLALFRVSPQPGVDPVEASAAVAGESSTATWTVVWTDLLTACDLYRAKAYKVDAGPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAASGETKGHYLNVTAATMEEMYERAEFAKQLGSIIVMIDLVIGYTAIQTMGVWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVIARNEGRDYVAEGPQILQDAAKTCGPLQTALDLWXDITFNYTSTDTADFVETPTANV

SEQ ID NO: 10839 - protein, 1483 aa, Eremothecium gossypii
MRARSEGPGRNLSPRTGVPRSPAVVSSQGILRSPSLKSGASPMSTLGLGWKHGQQSPTGHVAQYLSPLSADSSSAPSRKTSITGLSTLRGGSPSRKPRSNSVSSNFKMAEDAENNTPTLVLPPSLASLNSQSTLSTVYTGNPAAAANPEASSSSSKSGNSATSSLRSGYKPMKRQYVLNEQLYLSRMKNSHLDDYYTRGIAPTMNDDEEDDTDLDTPDVNIDNDDQAFGSNVFTFHDRETSRSVDNELVMLSTKHLLGKMNWLRELDPGNPDIEAPLEFLARAENVSINSATPQDNRQDIEGMLGKLSRNPLVQERLEWQTMLWNVLRGDIVNSEKTKLAEQRTTDELTTQFSDELWLELKSWLYGRSVEDQRTWLQYLRASTDSIFERIIEFRLEDDIEIPDAVVKVESLLNEYYKVIPYWKNCQQMYKEKPITNSDDFKLRIETLNTYVVMYAAFKTEITALHQWIGNDDPEAEGAAGGIEDIKCAEKPIAEQVLKEKDIETIFQNKIFYRHGPWVFKAKLAAIEYGDYFNLMNLPSLNGYLTTLITFPMKLIKEIILIRLNYARKLQKPTMMMIDQMIDDFKSYIKLAVQIIYTINLYCSNKELQLGNVIDDTFDKTVNDAISYFFKLLNLKLVDSTKKSFKNFKEPEALFSHWEDLKNVGCHIDGANEVVPTGFVSLTLRLLNKLHAYILKEQNSVTEKVSKAECEKWIMVTLENIGLFKRKMNRFSNVLTKALQNSANYRINDIRLLLQNLKDTGHFLIYTGGYLEDSGTYLFASKELLGYSGTDILRIVKGMEVGSDLIPEVSITNSLSVYTAIEQGVCSDPIFVQEERPDGLSYYHVQSECNKRHIGKSRGKIIHSYDSFYGSETEGSELYELERKLKSLGYLVAVCPDEPILWEGEMYNLSYEKQLNAEDFPVNITPGMLTLMAQGSTYSMEYQCDKFQHFAGNSVVFTEKRCSIVPAEQTLQKINKAYFRITYHTLAHHHKLVSTIQRKFRGFESLNTVFIFCRDFAKNFLRSNVASYETKSVIIMQMLKVSIGWLTFLIDDCDPNDPKTFRWCVLAMEFAMQMTSGWNILGISGEQFKTLKDKISGCMALLISHFDIMGVRSREAENTVMPQVRAIMDFETDDEETVQQLNTKMRLKAINELEQNTVNTRRQVGKVLDATDKDNQYLLTLASSLSNVSIKWQKRSFIGGGSFGSVYSAVNLDTGDILAVKEIKFNDRKTIKQVFPSIRDEMTVLEMLNHPNVVQYYGVEVHRDRVNIFMEYCEGGSLASLLAHGRIEDEMVTQVYSLQMLEGLAYLHESGVDHRDIKPENILLDFNGIIKYVDFGAAKVLASNGSKKLNLEQHMEGEKMIGTPMYMSPEAISGTGYGKFGSDDIWSLGCVILEMVTGRRPWANLDNQWAIIYQVAAGQIPMFPSKNEMSQAGIKFLSRCLIQDPNQRSTAVELLMDPWIIEIRTIAFGDDTVEPVSKERPLNS

SEQ ID NO: 10840 - protein, 548 aa, Oryza sativa (japonica cultivar-group)
MAAASSAHYFGLGEPQMQQQQQQPPLQNNAAAPVAATPPPKKKRNQPGNPNPDAEVVALSPHTLLATNRFVCEVCNKGFQREQNLQLHRRGHNLPWKLKQKNPKETRRRVYLCPEPSCVHHDPSRALGDLTGIKKHYSRKHGEKKWKCDKCNKRYAVQSDWKAHSKTCGTREYRCDCGTLFSRRDSFITHRAFCDALAQESGRIMPPMGAALYAAAGAGMAIGGLTGMAASHQLQPFQDHSSAITTAANAAAQFDHLMATSSAAAGSPAFRAAQPTSSSSSPFYLGGGGDDGQAHTSLLHGKPAFHGLMQLPEQQGSNGGGLLNLSYFSGGNGGHHHHHQEGRLVFPDQFNGVAAGNGARAGSGEHGNSGNNADSGSIFSGNMMGGGGGFSSLYSSSDQTVPPPQMSATALLQKAAQMGATTSSGGAGSVNSLLRGLGSGGGGGALNGKPAGAAGFIMSGESSSRSTASQTAENESQLRELMMNTLSATGGGTGAGTVFVGGGFPGVDDGKLSTRDFLGVSGGAPGLQLRHGGAAGMGMAGSLDQEMK

SEQ ID NO: 10841 - protein, 447 aa, Sarcothalia livida
ALFRVSPQPGVDPIEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERFLYSMEGVNRAIAAAGETKGHYLNVTAATMEQMYERAEFAKQLGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGVDVVLQFGGGTIGHPDGIQAGATANRVALESMVIARNEGRDYVTEGPQILHDAAKTCRPLQTALDLWKDISFNYTSTDTADFVETPTANV

SEQ ID NO: 10842 - protein, 249 aa, Chrysanthemum x morifolium
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLLGEDLGPLNCKELESLERQLDTSLKQIRSARTQFMLDTLTDLQKKEHALNDANRTLKQRLMEGHQVTSLHWNPHVQQEMGYDQQHEPQHQNGEAFFHPLDCGPTLQMGYPSDSLTAEAAASVAGPSCSNYMPGWYQ

SEQ ID NO: 10843 - protein, 328 aa, Bacillus cereus ATCC 14579
MDLDVSGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 10844 - protein, 150 aa, Glycine max
RFHFGVMLIDFVPTESRVSLAEAPGFLKAPGGAPAIVAITVSCLGGRSAFIVKLGDDEFGHMLAGILRKNGVADQGINFDTGARTALAFVTLKADGDREFMFYRNHSADMLLRPDELNLDLIRSVRKSPLSIPHDLQEIQMEVEIHSLVF

SEQ ID NO: 10845 - protein, 514 aa, Triticum aestivum; identical to SEQ ID NO: 5041

SEQ ID NO: 10846 - protein, 504 aa, Glycine max
  unsure (1)..(504): unsure at all Xaa locations
MSSTTQNRRSSFTPSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRXVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQRLQLLGVSCMMIASKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKYKCVAKKHIPPSIPREVFQIN

SEQ ID NO: 10847 - protein, 482 aa, Comamonas sp. NCIMB 9872
MNSSLHYNYVGGDWVNGATERHNLNPSDLSDSIGIYVGANEAQTQAAIDAAFDARTAWACWTAEQRADALDRIGTSILASAKELGHLLSREEGKTLAEGIGEAARAGRIFKYFAAEALRCGGDLLPAIRPGVSVEVTREPEGVVGIITPWNFPLAIPAWKIAPALAYGNTVVFKPADLVPGSAWALTEIIHRVGGLPPGVFNLVMGPGSKVGNTLANAPKVRALSFTGSATTGRQVGLACMERGAKVQMEMGGKNPLVVLNDADLQSAASVAIQGSFYSTGQRCTGSSRLIVEAGIHDAFVEAMRQQMSALSIGHALKQGTDIGPVASEDQLQQDLEYIRIGVAEGGRLYCGGSQLERETEGFYLSPALLTETDNSMRINREEIFGPVASVIRVGSYEEALHTANDTVFGLSSGICTTSLKYASDFKRRSAAGMVMVNVPTAGVDYHAPFGGRKGSSYGAREQGAYAREFYTVIKTAYTSAG

SEQ ID NO: 10848 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNTGLAAYIFTKSIPRSWRVSESLEYGLVGVNEGIISTEVAPFGGVKQSGLGREGSKYGIDEYLELKYICMGNLG

SEQ ID NO: 10849 - protein, 148 aa, Zea mays
MGVHLLKKQHSSAPSSLGRGSGSGSGSASGSSASASSMPPKGCMAVRVVGPSSAAAGGGRKEQQEEEEEERFVVPVGYLKHPLFVALLQAAEEEYGFEQKGAITIPCGVDHFRRVQGIIHHHGSGGGHHHGHHSSSSNHFHIAGCFRA

SEQ ID NO: 10850 - protein, 438 aa, Corynebacterium glutamicum ATCC 13032
MGADQIAAVSGNSAWMLMSASLVLLMTPALALFYGGMSRQKSVLNMMMMSFGALGVVTVIYLLWGWSMSYGTQSIAGIFANPFEFFGLKDSIVDADGNYIEGAAGYPNIIDIGFQLTFAVISTALISGALAERVKFSTWLIFSGAWVTLVYFPLAHMVWGGGLLGHNVTGFASWLFGSTDGEANIAPIDFAGGTVVHISAGTAALVLAFIVGKRKTFGKAIARPHNLPMVMLGAALLWFGWFGFNGGSAFAADGLAGLAWVNTTAATAAAMLGWLATEKFRDGHATSLGAASGVVAGLVAITPAAGALTPVTSLILGAIGGILACLGVGLKYRFGFDDSLDVVGVHLVAGLWGTVGVGLLATDIGWFSGGGMDGLKLFIVQIVIALVAVVFAGVITALIAFALKATVGWRVDDDVEQQGIDTHEHAESAYDTTGPEIR

SEQ ID NO: 10851 - protein, 461 aa, Mesorhizobium sp. HB5A4
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLLYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 10852 - protein, 274 aa, Arabidopsis thaliana
MRSYGKEKKLVFPYVFIACCFFLAIFGFCFFNLFSQGISFSEIPTTRRSVNDETDSLDHGSSVSNIPFHGLSWNPRVFYLPNFATKQQCEAVIDMAKPKLKPSTLALRKGETAETTQNYRSLHQHTDEDESGVLAAIEEKIALATRFPKDYYESFNILRYQLGQKYDSHYDAFHSAEYGPLISQRVVTFLLFLSSVEEGGETMFPFENGRNMNGRYDYEKCVGLKVKPRQGDAIFFYNLFPNGTIDQTSLHGSCPVIKGEKWVATKWIRDQTYD

SEQ ID NO: 10853 - protein, 338 aa, Xanthomonas campestris pv. campestris str. ATCC 33913
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 10854 - protein, 352 aa, Medicago sativa
MASSINGRKPSEIFKAQALLYKHIYAFIDSMSLKWAVEMNIPNIIQNHGKPISLSNLVSILQVPSSKIGNVRRLMRYLAHNGFFEIITKEEESYALTVASELLVRGSDLCLAPMVECVLDPTLSGSYHELKKWIYEEDLTLFGVTLGSGFWDFLDKNPEYNTSFNDAMASDSKLINLALRDCDFVFDGLESIVDVGGGTGTTAKIICETFPKLKCIVFDRPQVVENLSGSNNLTYVGGDMFTSIPNADAVLLKYILHNWTDKDCLRILKKCKEAVTNDGKRGKVTIIDMVIDKKKDENQVTQIKLLMDVNMACLNGKERNEEEWKKLFIEAGFQHYKISPLTGFLSLIEIYP

SEQ ID NO: 10855 - protein, 385 aa, Oryza sativa; identical to SEQ ID NO: 3041

SEQ ID NO: 10856 - protein, 286 aa, Chloroflexus aurantiacus
MREHPLMLGLVGASGSGKTTLTQGIVRLLGAHGVTPVNLDDYLRYSRAERAVRGMTDADPAAIDLDRMAADLVALRAGRTIEKPVYDHTIGAPRGSERVAPTGLVIAYGALTLTPPVQVELFDLTVYFDPHPALYRRWREERDVLQRGYTLAEVQAAWPARERDIQQYIVVQRPLADVVVRFVPGETGIDLHLLLRRRALTFEMADVGQETGSSAVQIQQLAADEDGLPAVLVTATSDPALDRLSEALRARLPRSGQVTGDSLNATHPTLRFAQTLIATLLLHKSL

SEQ ID NO: 10857 - protein, 293 aa, Vibrio fischeri
ALYESDNPDKIEVVAVNELSQPEAMAHLFQYDSTHGRFQHKVTHDQEYLYIDLPNGSQDKVRILHQADLSLLPWQSLEVDLILDCSGVYGSKADGEKHINAGAKKVLFSHPGGSDLDNTIIYGVNHDTLLPEHRIVSNGSCTTNCIIPVIKAIDDVFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 10858 - protein, 1314 aa, Oryza sativa
MEKGKMAEPKTAIDKELVRHSSFDSTAITTSLPNASQKTSKTSIVHFEHQRKSPEHHFLNAANTNAPRKLQHVIVAKLHCTLTKQLRLHLEENEESCTLATSRMEPRRRRPRRKARLTELRRGVHERPSLHGKGSWPAKAFVSVIQNHPIHPCNERRRTTTSSLQPPSLAHHPQLRQIHQSAEPPSLHHPLLHRPPAEAAMGPAVEARPAIGTTSAPLRRAKTPVGAAGGHHFLRAQGPPATAAFPALARAYRPPPLLGSSPSSAGQEGDGSGQGATAITGSGRRHHRAEGHHRLAAASPIETRVLHRCRSLPLSASVVSPTALARSSGGGEVEDGEEDLVYNTNSMKNRSNRKPDATMRAVEHAEQNCTKGRREKGFRFLRDFPADSSPHRLDRARARPPRIRFIPLPSPRLRSMEKDHQPVISLRPGGGGGGPRPGRLFSPAFAAAASGSGDLLRSHVGGASKIGDPNFEVRERVRYTRDQLLELREIVDIPEAILRINQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPCILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAMKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSAKTASCILYSLGVSPQRNSRTGDVSNSQFCAVYFCKPPDAALHCSSSSSSISLVCFSAASDRLHHLPLPFPLRCHANASEQSNLPRGSSAGAAAGACAGPELHRRLARSSLGTCLLYGMTGICGLYERKIRDINPMARDLTYDINDLYNFIDGLTDISALVFDRSLHAFLPYDRRWIKQEMFQHLKRLAQQ

SEQ ID NO: 10859 - protein, 469 aa, Capsicum chinense
PIPVPVFGNWLQVGDDLNHRNLTDYAKKFGDIFLLRMGQRNLVVVSSPESAKEVLHTQGVEFGSRTRNVVFDIFTGKGQDMVFTVYGEHWRKMRRIMTVPFFTNKVVQQYRGGWESEVASVVEDVKKNPESATNGIFLRKRLQLMMYNNMFRIMFDRRFESEDDPLFVKLRALNGERSRLAQSFEYNYGDFIPIFRPFLRGYLKICKEVKEKRLQLFKDYFVDERKKLANTKSMDSNALTCAIHHILDAQQKGEINEDNVLYIVENINVAAIQTTLWSIEWGIAELVNHPHIQQKLREEIDTVLGPGVQVTEPDTQKLPYLQAVIKETLRLRMAIPLLVPHMSLHDAKLAVYDIPAESKILVNAWWLANNPAHWKKPEEFRPERFLEEEKHVDANGNDFRFLPFGVGRRSCPGIILALPILGITLGRLVQNFEMFPPPGQSKLDTSEKGGQFSLHILKHSTIVMKPRSF

SEQ ID NO: 10860 - protein, 579 aa, Staphylococcus aureus
MAKIKANEALVKALQAWDIDHLYGIPGDSIDAVVDSLRTVRDQFKFYHVRHEEVASLAAAGYTKLTGKIGVALSIGGPGLIHLLNGMYDAKMDNVPQLILSGQTNSTALGTKAFQETNLQKLCEDVAVYNHQIEKGDNVFEIVNEAIRTAYEQKGVAVVICPNDLLTEKIKDTTNKPVDTSRPTVVSPKYKDIKKAVKLINKSKKPVMLIGVGAKHAKDELREFIEMAKIPVIHSLPAKTILPDDHPYSIGNLGKIGTKTSYQTMQEADLLIMVGTNYPYVDYLPKKNIKAIQIDTNPKNIGHRFNINVGIVGDSKIALHQLTENIKHVAERPFLNKTLERKAVWDKWMEQDKNNNSKPLRPERLMASINKFIKDDAVISADVGTATVWSTRYLNLGVNNKFIISSWLGTMGCGLPGAIASKIAYPNRQAIAIAGDGAFQMVMQDFATAVQYDLPLTVFVLNNKQLAFIKYEQQAAGELEYAVDFSDMDHAKFAEAAGGKGYTIKSASEVDAIVEEALAQDVPTIVDVYVDPNAAPLPGKIVNEEALGYGKWAFRSITEDKHLDLDQIPPISVAAKRFL

SEQ ID NO: 10861 - protein, 686 aa, Oryza sativa (japonica cultivar-group)
MAPWSGFWAASRPALAAAAAGGTPVVVKMDNPNWSISEIDADGGEFLAGGRRRGRGKNAKQITWVLLLKAHRAAGCLAWLASAAVALGAAARRRVAAGRTDDADAETPAPRSRLYAFIRASLLLSVFLLAVELAAHANGRGRVLAASVDSFHSSWVRFRAAYVAPPLQLLADACVVLFLVQSADRLVQCLGCLYIHLNRIKPKPISSPAAAAAALPDLEDPDAGDYYPMVLVQIPMCNEKEVYQQSIAAVCNLDWPRSNILVQVLDDSDDPITQSLIKEEVEKWRQNGARIVYRHRVLREGYKAGNLKSAMSCSYVKDYEYVAIFDADFQPYPDFLKRTVPHFKDNEELGLVQARWSFVNKDENLLTRLQNINLCFHFEVEQQVNGIFINFFGFNGTAGVWRIKALEDSGGWMERTTVEDMDIAVRAHLNGWKFVFLNDVECQCELPESYEAYRKQQHRWHSGPMQLFRLCLPDIIRCKIAFWKKANLIFLFFLLRKLILPFYSFTLFCIILPMTMFIPEAELPDWVVCYIPALMSFLNILPAPKSFPFIIPYLLFENTMSVTKFNAMISGLFQLGSAYEWVVTKKSGRSSEGDLIALAPKELKQQKILDLTAIKEQSMLKQSSPRNEAKKKYNRIYKKELALSLLLLTAAARSLLSKQGIHFYFLMFQGLSFLLVGLDLIGEDVK

SEQ ID NO: 10862 - protein, 229 aa, Oryza sativa
MARPLYPMMLESPQLRWAFVRKVYAILSIQMLLTIAVASVVVFVRPVALFFVSTPAGFALYIFLIILPFIVLCPLYYYYQRHPVNLLLLALFTAAISFAVGLTCAFTKGEVILESAILTAAVVVSLTAYTFWAARRGHDFSFLGPFLFAAVMILMVFALIQVFFPLGRVSLMIYGGLAALVFCGYIVYDTDNLIKRYSYDEYVWAAVALYLDVINLFLSLLTLFRASDS

SEQ ID NO: 10863 - protein, 333 aa, Prochlorococcus marinus subsp. marinus str. CCMP1375
MNPEKLDVVAIGNAIVDVLINTEESFLREHSLAKGNMTLITQEKAEELYSKSDPSLETSGGSAANTIAGLSELGSNAEFIGRVKKDALGNTFKDDICSTGAVFNTPPIKYGPSTARCFIYVTPDAERTMCTYLGASVLLETKDIDFSILGETKILYLEGYLWDLEKAKSALKASAEECKKLGGKIALSLSDSFCIERHRESFQELLEKNIDILFANENEIISLYNSSSLDDAIENIKPKCEIAVITIGGKGSIIISGDEKYLIKPYNFGKVIDTTGAGDLYASGFLHGYVNGLDLQTCGNIGSTCAGYIVSQLGSRSKVSLKDIVIERLGLPA

SEQ ID NO: 10864 - protein, 486 aa, Arabidopsis thaliana
MPEDSSSLDYAMEKASGPHFSGLRFDGLLSSSPPNSSVVSSLRSAVSSSSPSSSDPEAPKQPFIIGVSGGTASGKTTVCDMIIQQLHDHRVVLVNQDSFYRGLTSEELQRVQEYNFDHPDAFDTEQLLHCAETLKSGQPYQVPIYDFKTHQRRSDTFRQVNASDVIILEGILVFHDSRVRNLMNMKIFVDTDADVRLARRIRRDTVERGRDVNSVLEQYAKFVKPAFDDFVLPSKKYADVIIPRGGDNHVAVDLITQHIHTKLGQHDLCKIYPNVYVIQSTFQIRGMHTLIREKDISKHDFVFYSDRLIRLVVEHGLGHLPFTEKQVVTPTGAVYTGVDFCKKLCGVSIIRSGESMENALRACCKGIKIGKILIHRDGDNGKQLIYEKLPHDISERHVLLLDPVLATGNSANQAIELLIQKGVPEAHIIFLNLISAPEGIHCVCKRFPALKIVTSEIDQCLNQEFRVIPGLGEFGDRYFGTDEEDQ

SEQ ID NO: 10865 - protein, 502 aa, Corynebacterium efficiens YS-314
MTAVIPAALQRREQLNLPYTHVDDFYINGAWVTATGEKRNPVVDPATGQEWGSVPEAGQVELDHAVGAAREALPGWGSLTAADRAEYLVRIAEEIEKRAEVLALTNTRENGSPISETRGAAANAAGIFRYFATLAPFLDDPDIRPFPAGGAESLVDKDPIGVCALIAPWNFPINLVVIKLAPALLAGCSVVIKPASPTPLSIRFIIEAVEAAGVPAGVINLLTGSGRFGDAMVRHPGVNKVAFTGSTPVGRKIASACGELLRPVTLELGGKSSAIVLPDADMSVLSARLIRSCMRNTGQTCYISTRIIAPASRYEEVVQVVADTIAAGRQGDPLDEDTIFGPVATASQYATVMEYIESGHAEGARAVTGGAATAGLTGGLENGVFIEPTVFADVTPDMRIAAEEIFGPVISILRYDDSAGVEEAIAIANNTEFGLGGLVFGADEDRALDVARRVDSGSVGINFFGSNHSAPFGGRHDSGMGVEYGIEGLSAYLSYKSIHRMV

SEQ ID NO: 10866 - protein, 84 aa, Glycine max
  unsure (1)..(84): unsure at all Xaa locations
KERGQLYGLWEGVAFLRAFSSPFNFILCEVPSGKDPKNLXGGLGHXGCDEVVSYDKKDLKGYVRVAMGXPVPADSLMKGLKTLS

SEQ ID NO: 10867 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 10868 - protein, 198 aa, Pseudomonas putida
MLLMMIDNYDSFTYNVVQYLGELGAEVKVIRNDEMTIAQIEALNPERIVVSPGPCTPSEAGVSIEAILHFAGKLPILGVCLGHQSIGQAFGGDVVRARQVMHGKTSPVHHRDLGVFTGLNNPLTVTRYHSLVVKRETLPDCLEVTAWTAHEDGSVDEIMGLRHKTLNIEGVQFHPESILTEQGHELFANFLKQTGGRR

SEQ ID NO: 10869 - protein, 370 aa, Triticum aestivum/Thinopyrum intermedium alien addition line
DLFSLSLVVDLIGHRYYTGGPIPTYISVYINAAALCGTVPGQLVFGWLGDKMGRKRIYGVTLLLMVFCSLASGFTFGKSNYKSVVITLCFFRFWLGVSIGGDYPLSATIMSEYANKKTRGAFMSAVFAMQGFGNVVAGLVGMITSQVFRKSSPGNIDVVWRIVLMFGAVPALLTYYWRMKMPETARYTALIAKDANMAAADMSAVLSMHIVPEEDNLGSHDQYGLFSSEFRQRHGLHLLSTTVCWFVLDVTFYSLNLCMKDIFTTVGLLKGHDDEVCKVNTCQVARYHKADNPFQRTIDITAVHMAIAAGCTLPGYFFAVAFIDRIGRVKIQLLGFTMMTVFQLCLAIPYDKWLECNNNKYGFAVMYGFI

SEQ ID NO: 10870 - protein, 257 aa, Vicia faba
MVTGKNNELSKTPGASANGIHSKSGESASEGSSEGSDENSHNVLQDSQLKSGERQDSFEDEPSQNGSSAQAPQNGGLNTPHTVVNQTMSVVPMSVAGPIAAVAGPTTNLNIGMDYWGTPASSTIPAMHGKVPSTAVAGGMVNAGPRDGVHSQPWLQDERELKRQRRKQSNRESARRSRLRKQAECDELAQRADVLSEENASLRAELSRIKSEHAKALAENAALKVKQGEILRNEEIVPGQNDQLVEHVGGGETKQSG

SEQ ID NO: 10871 - protein, 642 aa, Zea mays
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 10872 - protein, 386 aa, Zea mays
  unsure (1)..(386): unsure at all Xaa locations
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIXFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 10873 - protein, 493 aa, Triticum aestivum
  unsure (1)..(493): unsure at all Xaa locations
MKPDRKGGRVRSGTRTPPPNQPPRRIQTDPHPKSPKPSPATMGQGTPGGMGKQGGAPGDRGKPGGDGDKKDKKFEPPAAPSRVGRKQRRQKGPEAAARLPGVAPLSKCRLRLLKLDRVKDYLLMEEEFVAAQERLRPTEEKTEEDRSKVDDLRGTPMSVGSLEEIIDESHAIXVSSSVGPEYYVGILSFVDNDYDXPGCSKSFSNYKSHLVGFLQDEFDPMVSVMKVEKALLESYDEIGGLDALLKEIKEAAELPLTHPEVYEDIGIWSPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATXNRIESLDPALLRPGRIDRKIEFPLPDIKTRRRIFQIHTAKMTLSDDVNLEEFVMTKDEFSGADIKXAICTESGLLALRERRMKVTHADFKKAKEKVMFKKKEGVPEGLYM

SEQ ID NO: 10874 - protein, 200 aa, Glycine max; identical to SEQ ID NO: 1856

SEQ ID NO: 10875 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKGDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 10876 - protein, 296 aa, Acinetobacter calcoaceticus
MSLKRKGIILAGGSGTRLHPITKGVSKQLLPIYDKPMIYYPLSVLMLAGIREVLIISTPEDLPNFEKLLGDGSQFGIELSYKVQPSPDGLAQAFLIGEEFIGTDPVCLILGDNIYYGQHFSQQLEAASALPNGATVFGYHVTDPERFGVVEFDNTGKVLSIEEKPLKPKSAYAVTRLYFYDNRVVEFAKQVKPSARGELEITDINNAYLNDGSLNVELLGRGFAWLDTGTHESLLEAGQFIYTIEKRQSFKVACLEEIGFHQGWISKEQLLDSAEALKKTEYGQCLKKVWEESNEG

SEQ ID NO: 10877 - protein, 480 aa, Thermosynechococcus elongatus BP-1
MSQQDFGVIGLAVMGENLALNVERNGFSVAVYNRTPARTEAFMAERAAGRRFKATYTLEELVASLSRPRRILAMVKAGQPVDDLIQQLKPLLEPGDILIDGGNSLYTDTERRVAEMESAGLCFFGMGVSGGEEGALNGPSLMPGGSREAYQALEPILTKIAAQVDDGPCVTYIGPGGSGHFVKMVHNGIEYGDMQLIAEAYDLLKNLLGLNHQQLHEVFKSWNETPELNSFLIEITSQIFTYIDPETHLPLVDVIVDAAGQKGTGRWTVESALEMGVAIPTITAAVNARIMSSIKAERMAAAQVLPGPAAHFSGNTEEFIGKIRDALYCSKICSYAQGMALIAKGSQELFDHQLNLSEIARIWKGGCIIRAGFLNKIKQAYSENPQLANLLLAPEFRQTILDKQAAWREVLVEATRAGIAVPAFGASLEYFDSYRRDRLPQNLTQAQRDFFGAHTYERIDKPGTFHTEWVPIQEAGKASV

SEQ ID NO: 10878 - protein, 163 aa, Corynebacterium efficiens YS-314
MTVQGMELTGAVITVSDRVMSGEREDRVGAVARELLSQAGVEVVSSVTVPEGRDMVAGELESAVNRGIRVIVTTGGTGVGPRNRTPEATEPLLETQLSAVMTQILITGLSTTNQAGLSRGLVGLTTRDSGSSLIVNAPGSPGGVRDALGVVCPLLAPIFERLY

SEQ ID NO: 10879 - protein, 284 aa, Oryza sativa (japonica cultivar-group)
MAISGEDRYAAAGGGGDSGGGKLWNLCRMPFWQPGGAPATASAPPPPSSSSSSAGIHHHSAGRYGHEGGGGGAVAGDGAPAGSISSVAKSLLPARRRLRLDPPNKLYFPYQPGQQVRSAIRIKNTSKSHVAFKFQTTAPKSCFMRPPGAILAPGETIIATVFKFVEHPENNENVLQKCKVKFKILSLKVKGPMDYAPEMFDEQRDQAVVEKILRVVFLNVENPGPQLEKLNNQLAEAEAALEARKKPPEENGPKIVGEGLVIDEWKERRERYLAQQQVEVVDSV

SEQ ID NO: 10880 - protein, 562 aa, Escherichia coli O157:H7
MASSGTSSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIEAQPAVAEKAVAPAFSEESIRDAAAMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPQVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYKQGVFAATYPGKINFMQIAAGFGLETCDLNNEADPQAALQEIINRPGPALIHVRIDAEEKVYPMVPPGAANTEMVGE

SEQ ID NO: 10881 - protein, 514 aa, Zea mays
  unsure (1)..(514): unsure at all Xaa locations
SPPWPPPASSSSWSPPSWRLPSSPTRARAATRRRSSSPSPPSSGRTRTPPTRRRSPPQSSPSSASAASGRTRSAAPWRSPPSSRRSPPRPPRTAPRTSSSSSPASSSASAAEPSTAVPPGLRESKPVYLSXCNLPGLPHPTFSRDPVPFFLTPRTSNKMGLEAAVEATVEFLNKAVKPVLVAGPKLRVAKAGKAXMVDASGYAYAVMPSAKGLVPETHPHFIGTYWGAVSTAFCAEIVESADAYLFTGPIFNDYSSVGYSFLLKKEKAIIVRPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVLINNGGYTIEVEIHDGPYNVIKNWNYTGFVDAIHNGLGKCWTSKVKSEEELTAAIETALGEKKDCLCFIEVIAHKDDTSKKLLEWGFRVSAANSRPPNPQ

SEQ ID NO: 10882 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 10883 - protein, 1083 aa, Oryza sativa
MAVLTATELSEGGEVGRSAISSTEKKEERNRKQREYRERKKAESKRVSEDDATLSVLDKENIDPDDPIDWLHRNDMYKRQKKKSESEIIEQNQQSPFSDGIMQCHTTQIPNVHEAIPDNDYVEFDSALFEPANEGGVDDGRVEDEQGADNDFDEASQVLEDDGYESYRVGVSGVNGIEDADALAHRVWRSPDLDINLVRVILGILAKNPYGVVDVLSSGETSGSAVGKRVVLPRSFPGGDRDMQRRFLNAMALVQRFGRPDYFITMTCNPYWDEITENLEPGQLPQDRPDLVARIFRAKLRDMLDLFVKKKYFGEVQAYAHVTEFQKRGLPHEHILLIMKSGSKLTTPDEYDKVICAEIPDKAKYPELHLLAIKHMLHGPCGTLNKNCACMVDGECRFDFPRQFNQATQQGKDSYPLYRRRDDRWRVKIRGAELDNRMLGFPLFGIYPAVLQLQLHLPNMQYVTYNEDGNLEDVVNRPSSSRTTLTEYFKMNQVDPEARKLLYKEFPEHYRWIIGQNVWQKRKTQRGQVGRVVYAHPGEGERYNLRVLLNHVRGATSFEDLRTMSVTDIRALWDNHKATMSEDYSRGNTNPAAVEQMVLRDIRDLLHSMGNDITEYGLLEISDIGERTNDVMTEIIEELNVLVDQDHLDIYTSLNDEQRAGFDEIIDNVTNKKSQIFFIDGPGGTGKTFMYKALLARVRSEGLIAIATATSGIAASILPGGPVETLDRYLQDIMGYLLPFGGKVVVFGETCLLRNLTQGVFEMSGRRSFFASKKPSRSSNPFDSDSDDGGREQRPARASSVPPPADQRGSLFGGGDGFSASSAAARSRYRNDFRDTGGVEAQSVQELEGYAAYKAEETTQRVQGCVRIAEEMRDTASKSLVTIHQQGQQITRTHMMTLDIDQDLSRSEKLLGDLGALQKVEMEKAKQDDGLSDLSNILTELKGMAVDMGTEIDRGYSSRATAPRHSNLSVVRAHRSGQLPTHGPPTPNGRRNQRFLWKATAREAKVDGIMMWTLAPVLELERIAVDSGGDPDAIHHCAQTYFDAADIVVKKKNKLINSGWLYARGAADLNDLYLVYVMRKQVY

SEQ ID NO: 10884 - protein, 469 aa, Azotobacter vinelandii
MQTSTYTSDQTAQVAPARKDLAALIAIVAALGGLLFGYDTGIIGVALLGLSQDFVLNDTLKQFVTGAIIFGALFGCLLTGPISDRIGRRRTIIGVGLVFALGSLLSALSPSVGFLVVSRFLLGLSAGSSTQIIPVYIAEVAPPQHRGKLVVLFQLMVMTGITVAYFTGFALGEHWRWMFGLGVVPALILLAGMAILPESPRWLLVRGREAAALSVLTHVRGDAHWAARELEEIKTVSREPQGTWRDLRLPWIRPAVIVGGAIAMFSQITGVNAMIYYAPTILTQAGFSTDTAVLATGSSTILVVLMTWFGSVLVDRIGRRRYLLWLIPGSIAALIGMGLLFQSGGPTTTLEQWLVVLCLAGYLMLNCGGFGVCIWLINSEVYPLFIRGKGASVGAFSHWFFDLLVTLTTLSLVTALGAANTFWMYAAISTGALLFIWRYVPETRGKSLEQIEHELREHRFYPFQQKTEH

SEQ ID NO: 10885 - protein, 335 aa, Chlamydophila pneumoniae CWL029
MKVVINGFGRIGRLVLRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 10886 - protein, 411 aa, Glycine max
  unsure (1)..(411): unsure at all Xaa locations
MLLLLVLLLHQPIWAADPPASSPALSPGEEQHHRNNKVVIAIVVATTALAALIFSFLCFWVYHHTKYPTKSKFKSKNFRSPDAEKGITLAPFVSKFSSIKIVGMDGYVPIIDYKQIEKTTNNFQESNILGEGGFGRVYKACLDHNLDVAVKKLHCETQHAEREFENEVNMLSKIQHPNIISLLGCSMDGYTRLVVYELMHNGSLEAQLHGPSHGSALTWHMRMKIALDTARGLEYLHEHCHPAVIHRDMKSSNILLDANFNAKLSDFGLALTDGSQSKKNIKLSGTLGYVAPEYLLDGKLSDKSDVYAFGVVLLELLLGRKPVEKLVPAQCQSIVTWAMPHLTDRSKLPSIVDPVIKNTMDPKHLYQVAAVAVLCVQPEPSYRPLIIDVXHSLIPLVPIELGGTLRVSQVI

SEQ ID NO: 10887 - protein, 491 aa, Schizosaccharomyces pombe
MSLDKQIPIIYDFGENYEKNKDIWRRQCIYQILTDRFALDDHCTTAPSTGRMYLGGTWRGIIQKLDYIQSLGCTAVWISPIVKNIEGVTGYGEAYHGYWAEDLTQLNPHFGTKQDLTELVDQLHKRNMLCMIDIVVNHMAHAGDSPIDYSKYAPFNSPSHYHPKRFLHNYDDTWDCEIAWLGDEVVSLMDIRTEDQEVHNFFQNWIRDLIQTYHFDGLRIDTAKHVQKEFYPPFIAAANVFAFGEVYHGDPKFIAKYLEYIPSAANYPLYYQIENTFFPPKQSMNIFYQKAILEARATSMDTTILGNFTENHDVPRFLNRSTDYSLLCNTLTLLLFTDGIPIIFQGQEQMYAGGHDPENRDALWTSNYNQQNPIFQFLKKLIKLRQFLVDNVSGFTTELSNMLFVNEHVYVFRRPGVIIVVSNAGSNSDVDTSAEFSITERESLEFIDVLSGSQFSSLPTEDSSTISMNLEFSFPRVLVHRGLFHSMNELA

SEQ ID NO: 10888 - protein, 871 aa, Schizosaccharomyces pombe
MSDSSSSSTSAFVSSLVFNFAIFCAFIGLFLCLRPREKHVYQPRCIIDTQPKEEKPEPSPSSPFGLFAYVVKRSETYLIQYAGVDGYFFIRYLFTFGALCILGCLVLFPILLPVNATNGVGEKGFDILSFSNVKNHNRFYAHVFLSWLFFGFTIFIIYRELRYYVIFRHAMQSSGLYNNLPSSSTMLLTELPNSVLNDEETLHELFPNASEFTCVRDLKKLEKKVKKRSDLGNKYESTLNSLINKSVKKHNKLVKKHKPLPSTLDYTAYVKKRPTHRLKFLIGKKVDTIDYCRDTIAELDEVVDKLQTSLEERKKVGSVFIRFRSQTDLQTAYQAFLYSKKFRKYRFGRALVGIAPEDIVWSNLDLSMYTRRGKKTISNTILTLMIIFWAFPVAVVGCISNVNYLIEKVHFLKFIDHMPPKLLGIITGILPSVALSILMSLVPPFIKFLGKFGGALTVQEIENYCQNWYYAFQVVQVFLVTTMTSAATSAVVQVIKEPASSMTLLASNLPKASNFYISYFLLQGLSIPGGALLQIVTLLLSKVLGRIFDNTPRKKWNRWNQLSAPSWGTVYPVYSLLVTIMICYSIIAPIIIGFAAVAFVLIYFAYSYNLIYVLGHNADAKGRNYPRALFQVFVGLYLAEVCLIGLFVLAKNWGATVLEAVFLGFTVACHLYFKYKFLPLMDAVPISAIESVSERPEIKYPMDLGTSEMKNVGRAYPEILEKLSSSSGSDEFLETSSRTSENTKEKIDKDDEGFAITNISSVHKMPSFVLSYFSDLAASNRILTGFDRVLQLLPSFYDIPVRVRNVQYVSPALKATPPSVWIPKDPLGLSTYAIEDARGKVDIFDDNTTFNEKGNLQYTGPPPDYDEAIRS

SEQ ID NO: 10889 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10890 - protein, 397 aa, Oryza sativa
  unsure (1)..(397): unsure at all Xaa locations
MATFSGTDRLRDLHAFDDTKAGVNGXLVDAGVTTVPYFFRHHPEPLPVAAPSEAAAAIPLIDLAKADVDRGHVVSQVRSAAESAGLFQVVNHGVAGELMDAMLAAARRFNEQPAEAKAPYYTRDLGSKVRFFCNFDLFQSPAAQWRDTLYVEMVPDAPSPEEIPPPLRGVAEEFAAAVWRLGERVTELLSEALGLPPGYLAEHAGCMDGMSMVAQYYPPCPEPEKTMGTTRHSDPSFLTVLLQDESGGLQAVLPRPPEERWVDVPPVAGALVVNVGDLLQLVSNGRLRSMEHRVLPTAASAARARVAVACFFRLEYSASLTRPRSYGPIVDSGEGGARRAAAVYRSTTPRDFLAYFNGKGLDGRSALEHFRIPEAAAASSAVDVVSSSTTAAASIPR

SEQ ID NO: 10891 - protein, 469 aa, Glycine max
MDKVNRVCAKDEERPLRITRARARALRGITPYSRPSLKNEQKNVLRANSKRAASSGNKTFAVVPAVVQQKGRAVLSDISNMCAKPHDKCTKASKFQAKGVCTKKNTKLAASSVSTDVSSSHDDVRAKLAEELSTIKMVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSVQSLFQNQV

SEQ ID NO: 10892 - protein, 154 aa, Triticum aestivum
  unsure (1)..(154): unsure at all Xaa locations
HGHDNWIICLSFNHLANLAGLLGGYGAFPLSIIEYLWRAKQPYNVSVAAEVSACAALQNPVYLESVKNLLLQERERLYNLLKGIPYLKPFPNHANFFLCEVMXGKDAKKIKEDLAKMGVMIRHYYNKELKGNILISVGKVLSTLMHIMEGFKAL

SEQ ID NO: 10893 - protein, 156 aa, Klebsiella pneumoniae
TDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIK

SEQ ID NO: 10894 - protein, 187 aa, Triticum aestivum
  unsure (1)..(187): unsure at all Xaa locations
VTKVHARQIFDSRGNPTVEVEVTTAKGVFRAAVPSGAXTGIHEALELRDGDKSQYMGKGVTKAVNNVNSVIXPXLIESKIPVTEQKAIDDXLIXLDGTPNKGKLGANXILGVXFAVXKGXXGDKGXLFYVXFXDLVXXKKXXVFXVXVLNVMXGGFDXGXKFXMQEFMIXFSGAKRFKEVMKIGCEV

SEQ ID NO: 10895 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 10896 - protein, 518 aa, Lycopersicon esculentum
MDALCAGTAQSVAICNQESTFWGQKISGRRLINKGFGVRWCKSFTTQQRGKNVTSAVLTRDINKEMLPFENSMFEEQPTAEPKAVASVILGGGVGTRLFPLTSRRAKPAVPIGGCYRVIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFVEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 10897 - protein, 395 aa, Hordeum vulgare
MALQAATSFLPSALSARKEGAAKDSAFFGVRLADGLKLDATSLGLRTKRVNTSSVAIRAQAAAVSAPTATPASPAGKKTVRTGNAIITGASSGLGLATAKALAESGKWHVIMACRDYLKTARAARAAGMPKGSYTIVHLDLASLDSVRQFVKNVRQLDMPIDVVVCNAAVYQPTAKEPSFTADGFEMSVGVNHLGHFLLARELLEDLKASDYPSKRLIIVGSITGNTNTLAGNVPPKANLGDLRGLAAGLNGVGSAAMIDGAEFDGAKAYKDSKVCNMLTMQEFHRRYHEETGVTFASLYPGCIATTGLFREHIPLFRLLFPPFQKYITKGYVSEEEAGKRLAQVVSEPSLTKSGVYWSWNKNSASFENQLSEEASDTEKARKVWELSEKLVGLA

SEQ ID NO: 10898 - protein, 654 aa, Tropaeolum majus
MGRFLLPILGWFLLLSCLSAFTEAEYMRYKDPKKPLNVRIKDLMSRMTLAEKIGQMTQIERKEATPDVISKYFIGSVLSGGGSVPAPKASPEAWVDLVNGMQKAALSTRLGIPMIYGIDAVHGHNNVYNATIFPHNVGLGVTRDPALIKRIGEATALECRATGIPYAFAPCIAVCRDPRWGRCYESYSEDHTIVQAMTEIIPGLQGDVPPDVKKGVPFVGGKTKVAACAKHFVGDGGTTKGIDENNTVIDSRGLFSIHMPAYHDSIKKGVATVMVSYSSWNGLRMHANRDLVTGYLKNKLKFRGFVISDWEGIDRITDPPGRNYSYSVEAGVGAGIDMIMVPEDFTKFLNELTSQVKKNIIPMSRIDDAVKRILRVKFVMGLFESPLADYSLANQLGSQEHRDLAREAVRKSLVLLKNGESADKPFVPLPKNAKKILVAGSHADNLGRQCGGWTIEWQGVNGNDLTTGTTILNAIKKTVDPTTQVIYNENPDSNYVKTNSFDYAIVVVGEPPYAEMQGDSFNLTIPEPGPTTISSVCGAVKCVVVVISGRPVVLQPYVSYMDALVAAWLPGTEGQGVTDVLFGDYGFTGKLARTWFKTVDQLPMNVGDKHYDPLFPFGFGLTTKPSNRTEFIGLIFGDLEMFSRYYVEGCKDGV

SEQ ID NO: 10899 - protein, 161 aa, Chenopodium rubrum
MSLIPNNWFNTGRRSNIFDPFSLDEIWDPFFGLPSTLSTVPRSETAAETAAFANARIDWKETPEAHVFKADLPGVKKEEVKVEVEDGNVLRISGQRAREKEEKNDTWHRVERSSGQFMRKFRLPENAKVDQVKAGMENGVLTVTVPKNEAPKPQVKAINVY

SEQ ID NO: 10900 - protein, 208 aa, Xylella fastidiosa 9a5c
MPYRVIVVDAYDSFVHILVSYFEQLGCKVTVLRKDDPGLLALIDPLYSDIIVLGPGPGPGHPSQSGYDIILNKNSGRLPVLGVCLGHQAIGLYYGCIIEYAKNLMHGKTSLIKHDGQGCYVSLNSRTLKVMRYHSIIVANKDIPSHMAVTSYSIDDNYIMGLRHQHLPIESVQFHPESIATECGLDLIKNFITTYTFNKKGCKYEELH

SEQ ID NO: 10901 - protein, 215 aa, Zea mays; identical to SEQ ID NO: 6590

SEQ ID NO: 10902 - protein, 309 aa, Bacillus cereus ATCC 14579
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLEGKDNEEKMERILHFVREITDNPTINYSSKVADSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGDMGIGIFGPALDANGNSIAGFKILELLSAQEGWSIF

SEQ ID NO: 10903 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 10904 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVIECAYVEGDGQYARFFSQPLLLGKNGVEERKSIGTLSAFEQNALEGMLDTL

SEQ ID NO: 10905 - protein, 660 aa, Bradyrhizobium japonicum
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAGPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDTVSYRLDYKGWEAAPSTASQTAWALLALMAAGEVDHPAVARGVEYLIATQNEKGLWDEQRYTATGFPRVFYLRYHGYSKFFPLWGLARYRNLRNTNSRVVGVGM

SEQ ID NO: 10906 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGYTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 10907 - protein, 440 aa, Wolbachia endosymbiont of Drosophila melanogaster
MNDDLDSTTKQEALKYHSRGGNPGKISIMPTKPLSTQYDLSLAYSPGVAAPCLEIAKNPEVVYDYTAKSNCVAVISNGTAVLGLGNIGPLAAKPVMEGKAVLFKRFADIDAVDIEVGTENIEDFINAVRYLGPSWGGINLEDIRSPDCFIIEKRLNELMDIPVFHDDQHGTAVVVAAGIENALDIVEKKLEDVKIIMNGAGAAGIACLEILKSMGAKNIVLCDKQGVIYKGRNEDMNEWKEKYAIDTSERSLLDTIKGADVFIGLSAKDVLNEEMLKSMGKDPIIFALANPDPEVRPEFAKSVRPDAIIATGRSDYNNQVNNVMGFPYIFRGALDVHATTINDEMKIAAADAIAKLAREPVPGEISAVYGSRKMGYGREYIIPTPFDPRLISIVAPAVAKAAVDSGVARKAIQDWSKYENQLKSRLSNVLSTLNLLSSHM

SEQ ID NO: 10908 - protein, 394 aa, Glycine max
  unsure (1)..(394): unsure at all Xaa locations
MALSRVVAQSSQSNLLKPLASYLSLRRRSVSTSSDPLTIETSVPFTSHNCDAPSRAVETSSAELFAFFHDMALMRRMEIAADSLYKAKLIRGFCHLYDGQEAVAVGMEAAITRKDCVITAYRDHCTFLARGGTLIEIFSELMGRRDGCSKGKGGSMHFYRKXGGFYGGHGIVGAQVPLGCGLAFAQKYCKDENVTFSMYGDGAANQGQLFEALNISALWDLPSILVCENNHYGMGTAEWRAAKSPAYYKRGDYVPGLKVDGMDALAVKQACKFAKEFALKNGPIILEMDTYRYHGHSMSDPGSTYRTRDEISGVRQERDPIERVRKLLLTHEIATEKELKDIEKEIRKEVDEAIAKAKESQMPEPSDLFTNVYVKGFGVEACGADRKEVRAILP

SEQ ID NO: 10909 - protein, 813 aa, Chlamydia muridarum
MHFDRMKINVESMKQAILERVYCGVVQTPQSASTRDIFTAVAKTVSEWMAKGWLKTQSSYYDNDVKRVYYISMEFLLGRSLKSNLLNLGLLDLVNEALSDLGYDFDQLVEMEHDAGLGNGGLGRLAACFLDSMATLGIPAYGYGLRYDYGIFDQQIENGYQVESPDEWLRYGNPWEICRGEYLYPVHFYGKVKHSMDSRGRDVAELVDSQEVLAMAYDVPVPGFNNDTVNSLRLWQAQSRHGFEFSYFNHGNYIRAIEDIALASNITRVLYPNDSISEGQELRLKQEYFLVSATIQDILRRYTKTHLSLDKLSEKVSVQLNDTHPALGIAEMMHILVDREELDWDVAWDTTTKIFNYTNHTILPEALERWSLDLFSKVLPRHLEIIYEINARWLKKVSQKYPGDDDKRRALSIIEEGSSKFINMANLAVIGTSKVNGVSSFHSQLIKNTLFKDFVEFFPDKFINVTNGITPRRWLALSNKRLSALLNRSIGTDYLTNLTHLNKVISLAEDSGFREEWHKIKIQNKEDLSARIYKELGVSVNPQSIFDCHIKRIHEYKRQLMNILRVIYFYNEIRNGSTEIVPTTVIFGGKAAPGYAMAKLIIKLINNVAHIVNNDPKAKDLLKVVFWPNYRVSLAEAIIPATDLSEQISTAGMEASGTGNMKFALNGALTIGTMDGANIEMAEHIGKEHMFIFGLLEEEISALRNEYYPQGICNANPKIQEILDMVLQARLPEEDKDLFKPIVNRLLNEGDPFFVLADLESYLDAHNRVARLFTQPEEWTKKSIYNVGGIGFFSSDRSITDYASNIWNVSQSS

SEQ ID NO: 10910 - protein, 504 aa, Arabidopsis thaliana
MASALSCSASDLIPLLSGGANATAAAAAAEYICGRFDTVAGKFTDAAYAIDNTYLLFSAYLVFAMQLGFAMLCAGSVRAKNTMNIMLTNVIDAAAGGLFYYLFGFAFAFGSPSNGFIGKHFFGMYDFPQPTFDYPYFLYQWTFAIAAAGITSGSIAERTQFVAYLIYSSFLTGLVYPIVSHWFWSSDGWASPARSENLLFQSGVIDFAGSGVVHMVGGIAGLWGALIEGPRIGRFGVGGKPVTLRGHSATLVVLGTFLLWFGWYGFNPGSFATIFKAYGETPGSSFYGQWSAVGRTAVTTTLAGCTAALTTLFGKRLIDGYWNVTDVCNGLLGGFAAITSGCSVVEPWAALVCGFVAAWVLMGCNRLAEKLQFDDPLEAAQLHGGCGAWGIIFTGLFAEKRYIAEIFGGDPNRPFGLLMGGGGRLLAAHVVQILVITGWVSVTMGTLFFILHKLKLLRIPAEDEIAGVDPTSHGGLAYMYTEDEIRNGIMVRRVGGDNDPNVGV

SEQ ID NO: 10911 - protein, 357 aa, Chloroflexus aurantiacus
MAEVAETAQPLLERATADELKHYYYQMLLLRRFEERAGEMYVKAKIGGYCHLNLGEEATIVGLMAALTPDDYIFTNYREHGYIIARGVPPGPVMAELFGKETGVSGGRGGSMHLFDRKTNFMGGYAIVGGQVPLAVGAAYALRYQNKPGVVVAQMGDGTTNIGAFYESLNLAKLWKCPVLFFIVNNGYGMGTSVEAGSSEPDLWKKGASFRIHGERVDGTDVLAVRDVVRRLRARAEAEGEPAIIDAVSFRFRGHSVIDSDRYRDPEAVRRGRELYDPIRKFATLLLDHGVVDDAWLKGIAEQVEREVQEAIDFANNSPDPKFEDLYKYMYATPVPNTPTAEDAIRAVKINRGEFDV

SEQ ID NO: 10912 - protein, 443 aa, Saccharomyces cerevisiae
MFVAPVSSQKLDTAIRKETTFVPMLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 10913 - protein, 194 aa, Glycine max
  unsure (1)..(194): unsure at all Xaa locations
MFAEENGLKGDPRLQAISQAIRVVPHFPIHGIMFQDITTLLLDHKAFKDTVDIFVDRYRDTHISVVAGIEARGFMFGPSIALGIGAKFVPLRKPRKLPGEVISEKYALEYGTDCLELHVGAVQPRXERAIIIDDLVATGGTMSAGVKLLERVGAEVVECACVIGVPDVKGQCRRIGKPLYVLVEPRKADKCYPD

SEQ ID NO: 10914 - protein, 719 aa, Zea mays
  unsure (1)..(719): unsure at all Xaa locations
VVENDLFKQDWRSRKKKQIFQYIVLKWSLVLLIGLLTGFVGFFNNLAVENIAGFKLLLTSDLMLKRRYIRAFFVYGGCNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTVAVYSTPDLIAIIVLGIIGGIFGGLFNYLLDKILRVYSIINERGAPFKILLTITISIITSMCSYGLPWLAACTPCPVDAVXEQCPTVGRSGNYKNFQCPPGHYNGLASLFFNTNDDAIRNLFSNGTSTEFQMSSLFIFFTAIYCLGLVTYGIAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 10915 - protein, 628 aa, Nostoc sp. PCC 7120
MKFSWRVLVLWTLPALVIGFFFWQGTFAGAPADMSKNAANTRMTYGRFLEYVDAGRVTSVDLYEGGRTAIVEAQDQDIENRVQRWRVDLPVSAPELISKLKDKKVSFDAHPARNDGAIWGLLGNLVFPILLITGLFFLFRRSNNLPGGPGQAMNFGKSKARFQMEAKTGVKFDDVAGIEEAKEELQEVVTFLKQPERFTAVGARIPKGVLLVGPPGTGKTLLAKAIAGEAGVPFFSISGSEFVEMFVGVGASRVRDLFKKAKDNAPCIIFIDEIDAVGRQRGAGIGGGNDEREQTLNQLLTEMDGFEGNTGIIIIAATNRPDVLDAALLRPGRFDRQVTVDAPDIKGRLEVLQVHARNKKLDPSVSLEAIARRTPGFTGADLANLLNEAAILTARRRKEGITLSEIDDAVDRVVAGMEGTPLVDSKSKRLIAYHEVGHALVGTLLKDHDPVQKVTLIPRGQAQGLTWFTPNEEQGLISRSQLKARITGALGGRAAEEIIFGSAEVTTGAGGDLQQVSGMARQMVTRFGMSDLGPLSLESQQGEVFLGRDWMTRSDYSESIAARIDSQVRLIVDECYQNAKKIMREHRTVTDRIVDLLIEKETIDGEEFRQIVAEYTDVPDKQQFVPQL

SEQ ID NO: 10916 - protein, 404 aa, Oryza sativa (japonica cultivar-group)
GPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 10917 - protein, 160 aa, Glycine max
  unsure (1)..(160): unsure at all Xaa locations
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 10918 - protein, 308 aa, Pseudomonas putida KT2440
MTSKLEQLKQFTTVVADTGDLDAITRLKPVDATTNPSLLLKAAAIPGYADLLKQVKADAKGNVDLACDKFAVAVGSGILKVIPGRISTEVDARLSFDEPALLNKARQLIALYEAAGVAKERVLIKLASTWEGIRAAEQLEKEGIQTNLTLLFSFAQAQACADAGVFLISPFVGRIYDWYKKSTGQEYVGAEDPGVQSVTRIYNYYKANGYNTVVMGASFRNIGQIEQLAGCDRLTISPELLQQLSDDQGELPQVLKPGNAGEAKQHLNESQFRWAMNEDAMGTEKLAEGIRQFARDQEKLEKLIAEKA

SEQ ID NO: 10919 - protein, 220 aa, Triticum aestivum
  unsure (1)..(220): unsure at all Xaa locations
GLAGAAGMGQELALNIAEKGFPISVYNRTTSKVDETVQRAKLEGNLPLYGFHDPASFVNSIQKPRVVIMLVKAGAPVDQTIATLAAHLEQGDCIVDGGNEXWYENTERREKAMEERGLLYLGMGVSGGEEGARHGPSMMPGGSLEAYQYIEDILLKVSAQVPDSGPCVTYIGKGGSGNFVKMVHNGIEYXDMQLIVEXXHVXKSXXKLTNXELATXFXRW

SEQ ID NO: 10920 - protein, 310 aa, Kluyveromyces lactis
MTLKSTVDDYTKEKKAGEGTYAVVYLGTKKSTGRSIAVKEIKTSQFKDGLDMSALREVKFLQELKHVNVIELVDVFMANDNLNLVLEFLPADLEIIIKDTSIMFSPADIKSWILMTLRGVHHCHRNFILHRDLKPNNLLLAPDGQLKIADFGLARLMASPQEILTSNVVTRWYRAPELLFGAKHYTSAVDIWSVGVIFAELMLRIPYLPGKDDVDQINVTFRALGTPTDADWPEVSSFSNYNKIQIYPPPSREELRRRFIAATENALELISGMMIMNPKKRWDAVKCLQSQYFQELPEPTLPQDLPKLNK

SEQ ID NO: 10921 - protein, 198 aa, Sulfolobus shibatae
MSNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIMGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 10922 - protein, 518 aa, Oryza sativa
MAAASSAPFFGLGDTQMPPPQNPTNPALHHHPNPFPAPVDAAAPAPKKKRNQPGNPSKFVCEVCNKGFQREQNLQLHRGGHNLPWKLKQKNPKEARRRVYLCPKPSCVHHDPSRALGDLTGIKKHYCRKHGEKKWRCDKCSKRYAVQSDWKAHSKTCGTREYRCDCGTLFSRRDSFITHRAFCDALAQENARMPPIGAGVYGGAGNMTLGLTGMAAPQLPAGFPDQAGQPSASAGDVLRLGGGSNGASQFDHLMASSSGSSMFRSQGSSSSSFYLANGAAHHAPAQDFGPEDGQSQAGQGSLLHGKPAAFHDLMQLPVQHQQSGNGNLLNLGFFSGSNGGVDQFNGGAGNGGQGSIVTSSGLAGNHGGGGGGFPSLYNSSEPAGTLPQMSATALLQKAAQMGATTSSYNAGGAGGASSLLRGASSHGISVGEGPANERSSYQNLIMGSMASGGGGAGFAGSFSGASGFGGAVDDGKLSTRDFLGVGVVQGISGSAAMGPPRHGAAGLHVGSLDPANMN

SEQ ID NO: 10923 - protein, 301 aa, Oryza sativa (japonica cultivar-group)
MPCSGERCRRVWWSAAAAVVAFFFVVFVAAAAAAATASMYDDVEVVWGGDHSFFFMDGDGDALALCLDETHGSGFRSRDAYLYARFDVDMMLVANNSAGTVTTLYLMPDDVPWEYHDEVDLEFLGNVTGEPYTLHTNIFANGVGGREQQFRLWFDPTADFHTYSIVWNPKHIIILVDGVPIRDYRNTAARGGPAFPTWQKMRAHGSLWNADDWATQGGRVKTDWSEAPFFAYYRGLRVTPCAPSPGVAWCGDEPPESPWFDQQEMDAAALSKARQEHLLYDYCEDTKRFKDTGLPVECTIN

SEQ ID NO: 10924 - protein, 367 aa, Corynebacterium glutamicum ATCC 13032
MTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 10925 - protein, 592 aa, Arabidopsis thaliana
MDVRSLPSNGVATIQDSAPTAATILGSSAATLGRHLSRRLVQAGVTDIFTVPGDFNLSLLDQLIANPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNHLEDAHEQIDKAIATALRESKPVYISISCNLAAIPHPTFASYPVPFDLTPRLSNKDCLEAAVEATLEFLNKAVKPVMVGGPKLRVAKARDAFVELADASGYPVAVMPSAKGFVPENHPHFIGTYWGAVSTLFCSEIVESADAYIFAGPIFNDYSSVGYSLLLKKEKAIIVHPDSVVVANGPTFGCVRMSEFFRELAKRVKPNKTAYENYHRIFVPEGKPLKCKPREPLRINAMFQHIQKMLSNETAVIAETGDSWFNCQKLKLPKGCGYEFQMQYGSIGWSVGATLGYAQATPEKRVLSFIGDGSFQVTAQDVSTMIRNGQKTIIFLINNGGYTIEVEIHDGPYNVIKNWNYTGLVDAIHNGEGKCWTTKVRYEEELVEAINTATLEKKDSLCFIEVIVHKDDTSKELLEWGSRVSAANGRPPNPQ

SEQ ID NO: 10926 - protein, 582 aa, Candida albicans
MLHKKETNDTFVQLNRSPSTGEQKSSGIWSSIKDSFKPALPQDKLTGVDDIPDRELTDIERININAANSNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVLICGGGPNHEFIGGKYWREPGPFANSFKGFASSLITAAFSFGGTEMIALTASESSNVRHALPKAIKQVFWRIVIFYLGSIIMIATLVPYNDKRLLGSSSVDVTASPFTIAIVNGGIKGLPSVINAVILISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 10927 - protein, 447 aa, Gelidium crinale
ALFRITPQPGVDPVEASAAVAGESSTATWTVVWTDLLPACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 10928 - protein, 188 aa, Zea mays; identical to SEQ ID NO: 5192

SEQ ID NO: 10929 - protein, 373 aa, Eremothecium gossypii
MLRLLNPRSTQTVSRATRLVIRLSSTAIPTTQKAVVFYEHGGELKYTDIPVPKPKPNEILVNIKYSGVCHTDLHAWKGDWAIKPKLPLVGGHEGAGVVVAKGANVTNFEIGDYAGVKWLGKTCMECEFCQKGFEPNCETPTLSGYTHDGTFQQYATADAIHAAHIPPGTDLAKVAPILCAGITVYKALKTAALIPGQWVAISGAGGGLGSLAVQYAVAMGYRVVGIDGGNEKEALFRSLGGETFVDFHKNKDIVSAVREATGGGPHGVVNVSVSTNAILQSVEYVRPTGTVVLVGLPPDATVKSDVLTHVLKSINIKGSYVGNRADTKEAIEFFTRGLVQSPIKIIGLSQLEEAYKAMEEGTSIGRYVVDTSR

SEQ ID NO: 10930 - protein, 199 aa, Yersinia rohdei
SSIGGWKGINESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 10931 - protein, 93 aa, Triticum aestivum
  unsure (1)..(93): unsure at all Xaa locations
LQEFGTSPIPPRVLTXCREKCIIQKXNNFKQAGERYRSFDPARQDRFIQRWVDALTDPRVXHEHRTIWXSYWSQCDAALGXKLASRLNLKXSM

SEQ ID NO: 10932 - protein, 345 aa, Zea mays
MALEAVVFPKEHLAGTAKARSASSLACGFRTEEVEDNGGVVLQGEASDAPGAGAATTWECWDAALCPCSTPPAGAVEECWDDVRHRLSASPPLPPAPSAAVAAPSSGHGKAAAAARRRRRQRPKAVKNTEEVESQRRNHIAVERNRRRQMNEYLSVLRSALPPSYPQRGDQASIVAGAINFVKELEHLLQSLEAQKRRRQGCTEPPAPAPFAGLFTFPQYSTAATGVVAGSGDGAGSGGGACAAGARRGVADIEVAVAESHASVKVVTPRRPRQLLRMVVALQCLGLTVLHLNVTTTADQLVLYSLSLKMEDQCRLSSVDDIAAAVNDILGKISDERASRHLLAA

SEQ ID NO: 10933 - protein, 333 aa, Bacillus anthracis str. A2012
MAEVKEKRHEELGLSDEQVLEMFRTMLLARKIDERMWLLNRAGKIPFVISCQGQEAAQVGAAFALDREKDYALPYYRDMGVVLAFGMTAKELMLSGFAKAGDPNSGGRQMPGHFGQKKNRIVTGSSPVTTQVPHAVGIALAGKMEKKDLVTFVTFGEGSSNQGDFHEGANFAGVHKLPVIFMCENNKYAISIPVEKQLACKNVSDRAIGYGMPGYTVDGNDPLAVYKAVKEAADRGRRGEGPTLIETVSYRLTAHSSDDDDRVYRDKEEVEEAKKNDSIVTFAAYLKEVGVLTEESEKQMLDEIMHIVNEATEYAENAPYAAPEDALKHVYAE

SEQ ID NO: 10934 - protein, 361 aa, Glycine max
  unsure (1)..(361): unsure at all Xaa locations
MTCCFFFLQISLSLLSLLSIYSNCANLVGCSYSKEALDVSAKLLEVNPECYAAWNYCLLAVQHLLSNSDSDPHSIFDDELKLVEIALRKNFKSYGAWHHRKWVLSKGHSSIDNEMRLLNGFQKMDPRNFHAWNYRRFVAELMKRSDEDELKYTEEVIATNFSNYSAWHNRSVLLSNLLKRKAEGYFPKEKVLEEEFEHVHNAIFTDPDDQSGWFYHLWLIQQTVKIDAPLLVSSWPSHGSNITLIGDNDLRGCGLSLLNGTLSNPGTLPIILYFNQAVEGINSSTVAIKSELLKEELIWKPLSMTIRYXNPNTAQXWVVYLNLGNFELQPSKTYSVEINIGHSKGIISSNGNTLMILPKFL

SEQ ID NO: 10935 - protein, 507 aa, Synechocystis sp. PCC 6803
MSNSILSKLNVGERSPVNRTHSSRTEAEKSSLFRFVRRKINSPWLACVPLTALIVAIWNAAAIAQDTEIVNITVETVNENVATLQGTLNAIWILIAAILVIFMNAGFGMLETGLCRQKNAVNILTKNLIVFALATIAYWAIGFSLMFGSSGNPFVGFGGFFLSGDHTNYGLSPFPEGLPVAVFFLFQVAFSATAATIVSGAVAERIKFNEFLIFSVLLVGIAYPITGHWVWDAGGWLYTMGFMDFAGSTVVHSVGGWAALAGAFLLGPRLGKFVDGRPGAIPGHNMGFAMLGCLILWIGWFGFNPGSQLAADQACAYIAVTTNLAASAGGLTATFTSWLKDGKPDLTMVINGVLAGLVGITAGCAGVSYWGSVIIGGIAGILVVYSVAFFDKIKIDDPVGAISVHLVNGVWGTLAVGFFNMEKGLFYGGGINQLIIQIVGILAIGAFTAIFSFVVWAILKQTMGIRVSGEEEMIGLDIGEHGMEAYTGFVKETDSFGSAVSGATVPE

SEQ ID NO: 10936 - protein, 427 aa, Batrachospermum involutum
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEEMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYNTLLLSHLDINLPQGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 10937 - protein, 446 aa, Chondracanthus teedii
LFRVSPQPGVDPVEASAAVAGESSTATWTIVWTDLLTACDLYRAKAYKVDPVPNASDQYFAYIAYDIDLFEEGSIANLTASIIGNVFGFKAVKALRLEDMRLPVAYLKTFQGPSTGIICERERMDKFGRPFLGATVKPKLGLSGKNYGRVVYEGLKGGLDFLKDDENINSQPFMRWKERYLYSMEGVNRSIAAAGETKGHYLNVTAATMEEMYERAEFAKQLGSIIVMIDLVIGYTAIQTMAIWARKNDMILHLHRAGNSTYSRQKIHGMNFRVICKWMRMAGVDHIHAGTVVGKLEGDPLMIKGFYNTLLLPYLKVNVPQGIFFEQDWASLRKVTPVASGGIHCGQMHQLLDYLGIDVVLQFGGGTIGHPDGIQAGATANRVALESMVIARNEGRDYVAEGPQILQDAAKTCGPLQTALDLWKDITFKYTSTDTADFVETPTANV

SEQ ID NO: 10938 - protein, 129 aa, Glycine max
MADPELEAIRQRRLQELMASHGGVGNQQNPEQEKAQDDAKREAEERRQMMLSQILSAEARERLARIALVKPEKARGVEDFILRAAQMGQITEKVSEERLISLLEQINNQTTRQTKVTIQRRRSVLEDDD

SEQ ID NO: 10939 - protein, 488 aa, Laminariocolax tomentosoides
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKVGLSGKNSGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 10940 - protein, 497 aa, Brucella melitensis 16M
MCLKRHIGEGAATRIRAQCDYAFTNIRGACMNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVPGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGGRASVVMVFIFFAFVLWALTQEPDTLAAMKVTPLWFVLLGIAYWVMKLKQKQS

SEQ ID NO: 10941 - protein, 334 aa, Bradyrhizobium japonicum USDA 110
MTSNPWLTLLGLINGFQVTQAIHVASTLRIADHLKGDSRSAEELAPLTQSHPGALYRLLRALAAVGVFEEDEDRRFALTPMGDCLRTDSATPIGAWAECVGSPYVWSTWGHLLHSIRTGENAFQSLNGKDIWNYRAERPEESAVFDRAMTEFSRGGAEAVIGAYDFSAFHHVVDVGGGRGLMLAAILTAHPRMQGTLFDQPGVIAGAEAVLEAHGVVDRCRMVSGSFFESVPEGGDAYVMRVVIHDWDDDEAIAILKACRRAMRETAKLVLIERIIAPANEVPATKFMDLHMLALPGGRERTRDEFSDLLAKSGFELTRVVPAGRINVIEARPY

SEQ ID NO: 10942 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 10943 - protein, 586 aa, Ralstonia sp. EDS1
QAMTPSEAFVETMVANGVTDMFGIMGSAFMDAMDIFAPAGIRLIPVVHEQGAAHMADGYARASGRHGVTIGQNGPGISNCVTAIAAAYWAHSPVVIITPETGTMGMGLGGFQEANQLPMFQEFTKYQGHVNNPKRMAEYTARCFDRAMSECGPTQLNIPRDYFYGEIECEIPKPMRVERGAGGEQSLQAAADLLSTAKFPVILAGGGVVMGNAVEECKALAERLGAPVVTGYLRNDAFPASHPLWAGPLGYQGSKAAMKLIAQADVVIALGSRMGPFGTLPQHGMDYWPKEAKIIQVEADHTNLGLVKKISVGIHGDAKATAAELSKRLAGKTLACDATKDARAQTIKAEKDAWEKELTEWTHERDPYSLDMIEEAKKEGGKFLHPRQVLRELEKAMPPRVMVSTDIGNINSVANSYLRFEEPRSFFAPMSFGNCGYALPTIIGAKCASPDRPAIAYAGDGAWAMSMVEIMTAVRHNIPVTAVVFHNRQWGAEKKNQVDFYNRRFVAGELENPSFAEIARTMGAEGITVDTLEDVGPALKKAIDMQMNEGKTCVIEIMCTRELGDPFRRDALSKPVRLLDKYKDYV

SEQ ID NO: 10944 - protein, 535 aa, Schizosaccharomyces pombe
MAKILTIVMLVFVSMAGWMFGADTGSIGGITNMRDFQSRYADRYDPVTDTYSYSSARQGLLVGMVNTGTTVGCLLSSPLGDRFGKRKCIMGWTLVYITGVIVQLTTIPSWVQMMVAKIWTGLGIGALSVIAPGYQSESSPPHIRGAIVTTYQLFITLGIFIAACINMGTHKYTTHPEAQWRVPIGINLLWGILMFFGMLFLPESPRYLAVKGRNEECMKILTRNAGLPADHPIMQKEYNAIQADVEAELAGGPCSWPQIFSNEIRYRTLLGMGVMAFQQLTGNNYFFYYGTQVFRGTGLNSPFLAALILDAVNFGCTFGAIFVLEYFGRRGPLIVGGVWQSICFFIYASVGDRALTRPNGTSNHRAGAVMIVFSCLFIFSFAQTWAPAAYVIVGESYPIRYRSKCAAVATASNWFWNFMISFFTPFISNSIGFKYGYVFAACNLCAAIIIFLFAKETKGLTLEEINQLYLSNIKPWNTGAYQRDREDIKQSDSEKERGPTSKLHEYVEHAPNSYASTHSTESENYPQQVTNPVGL

SEQ ID NO: 10945 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 10946 - protein, 220 aa, Streptococcus agalactiae NEM316
MSTNKIAPSILAADYANFANELKRIEETTAEYVHIDIMDGQFVPNISFGADVVSSMRKHSKLVFDCHLMVVDPERYIEDFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 10947 - protein, 796 aa, Schizosaccharomyces pombe
MVFSTVILEKIRDSSLKTDPSSDLRTQFWLAFLLGASACVFFCFFRKRWKVLYAPRTTIEGLNLPTLSSSYYKWLMDLVNIPDDVVQNCAGLDGYVFLLFFKMGIKFLSFASLLGVLIIMPVNKHFRGDAFGNITLSMPAKSEYFFSSPLVKKSIVQSPIIANGSELNVGVLGPSLFNPIGNLSDIPGLPQPGDGFLYLYVLFTYFISIFLLYVLFSSTKSIADIRQSYLARQNRLTDRTVFISGLPNELCSTENLKAYFDKLDVGSIDSLSICRNYSYMDILLSKKSKYVKKLEKYWSIYLSNCKKLGISTLPPSNYLSPNRAELESTPEQLLEVPWQHHQCHPLIKTHFFGIFGQKIDAIDFYSAKLYKISQQIENARSFDYPTTGQAFITFESMATAQIVAQTHIDSKSLMGLHIELAPAANDIQWHNTYIGRWHKFFQGWFITLVTFMIILLWTVPVGAIAVFINLDTIRRLWPELGRMIEDLPFLNSLLRTFLPTLVYSLFISISPFLFRWLSSMQGLSSRAEEEIYAVGKNYAYLFVNFFLVYVIAGSTSIWELAKDTTSFAHFLANRLPHQAQFFIDLIVLQGIGMFPLKLIQLGKLSSYFVRRSFVPYSIASKKFETPDSFSVGIFLPQPMFIMLICLCYSIISPLILVFGLIYFIIGFLVYKYELIYQMEHPQHSTGELWSTIFLRMIFGCVIMQLTMMGLMSLRKAYWLSTVIFPLLCFTVISAYNFSTMIRSSMQFVSLYYIRTHQSNTLSSESESRNSESSGSYVHPGFDLSNEELPLIDLNTA

SEQ ID NO: 10948 - protein, 89 aa, Glycine max
  unsure (1)..(89): unsure at all Xaa locations
VFYLNKFYSPDRQYPKDGSSXPKSLRYIGSMVADVHRTLLYGGIFLYPADKKSPNGKLRVLYEVFPMSFLMEQAGGQAFTGNQRVIYRK

SEQ ID NO: 10949 - protein, 419 aa, Grateloupia livida
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKTW

SEQ ID NO: 10950 - protein, 243 aa, Zea mays
  unsure (1)..(243): unsure at all Xaa locations
VLIGSNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFXLVGGASLKPEFIDIINAAAV

SEQ ID NO: 10951 - protein, 363 aa, Triticum aestivum
MEEIGHHFGLGATAHGQHHSQLPWGSSPLSAVIAPPPQQQQQQQQSAGYLAHSPLSLNTAPPSGSHGGGSGCSNPVLQLANGSLLEACAKAAKEPSSSSYAADVEAIKAKIISHPHYSSLLAAYLDCQKVGAPPEVLARLTAVAQDLELRQRTALGSLGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 10952 - protein, 222 aa, Chlamydophila pneumoniae CWL029
MLMMLMMIIGITGGSGAGKTTLTQNIKEIFGEDVSVICQDNYYKDRSHYTPEERANLIWDHPDAFDNDLLISDIKRLKNNEIVQAPVFDFVLGNRSKTEIETIYPSKVILVEGILVFENQELRDLMDIRIFVDTDADERILRRMVRDVQEQGDSVDCIMSRYLSMVKPMHEKFIEPTRKYADIIVHGNYRQNVVTNILSQKIKNHLENALESDETYYMVNSK

SEQ ID NO: 10953 - protein, 221 aa, Triticum aestivum
MTEVFNGYERQYCDLSANLSKKCSSALALDGEQKKQKLSEIRSGLDNAEALIRKMDVEARSLPPSIRTSLLVKLREFKSDLNNFKSEVKRITSANLNAAARDELLEAGLADTKTASADQRARLMMSTDRLGRTTDRIKDSRRMMIETEELGVSVLQDLHSQRQSLLRTGDTLSGVDENVGKSKKILTGMTRRMNRNKWTIGAIITALVAAIILILYFKLTK

SEQ ID NO: 10954 - protein, 486 aa, Pseudomonas syringae pv. syringae B728a
MTSQSLNSHHVDPDTALKLYIDGRWSAPLDPVSIAVINPATEEVVAHVASGSAADVDRAVAAARAAFAGWSGSSPHARAQVIGRIHELILERKEQLAQAISLEMGASISSARAMQVPLAAEHVRVARDLLATYRFHTVEGSTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAAAIVVGDPQLEETVLGPIANEAQFQRVQAMIDAGLSEGAKLVCGGPGRVQGHERGFYTRPTVFSEVDSSMRIAREEIFGPVLCLIAYDTVEEAIAIANDTVYGLGAHVQGQDLEQARAVASRIRAGQVHLNYPAWNPMAPFGGYKRSGNGREYGVQGFEEYLETKAIVGFA

SEQ ID NO: 10955 - protein, 158 aa, Oryza sativa
  unsure (1)..(158): unsure at all Xaa locations
MDPYKHRPSSGSNSTFWTTNSGAPVWNNNSALTVGERGPILLEDYHLIEKLAQFDRERIPERVVHARGASAKGFFEVTHDISHXKCAGFFPWFLXVXTXSYLFXXFQKXXXLGWEAPXEXWGFXGVFXXXFXNGWGXFXXXWGKXXXFFFXXGGFKGG

SEQ ID NO: 10956 - protein, 190 aa, Triticum aestivum
  unsure (1)..(190): unsure at all Xaa locations
MSATRPDHRRHQSPFLRDLSSPISSSFRMPPASVRREAQASTPPPPPPLLSLDDLSRHSPSPPPHTPPQAAMSPSPPPPRGGLFSTPQRSNGSPSPAAWWSPSREEKARDSSPVDGVVHQQQSPGTASAQQPQQQQVALITLXPPPREVARPEMPRDSVLSTGRVDEEEWVTVFGXLPVDXNXVLRXXEK

SEQ ID NO: 10957 - protein, 406 aa, Vibrio vulnificus CMCP6
MSDTASQVHGAVQTLTQSSDTLFLLLGAIMVFLMHAGFAFLEVGTVRHKNQVNALVKILADFGISTLAYFFIGYWVAYGAHFFADAETLAQGNGYELVKFFFLLTFAAAIPAIVSGGIAERARFYPVLIATFFTVGIVYPLFEGIIWNGNFGIQAWFEATFGVGFHDFAGSVVVHGVGGWIALVAVIFLGMRRGRVRAGKHTNFAPSNIPFLALGAWILCVGWFGFNVMSAQTLNGISGLVAMNSLMAMAGGIVAALIAGKNDPGFIHNGPLAGLVAVCAGSDLMHPLGALVTGSVAGVLFVYLFTYLQNKTKIDDVLGVWPLHGVCGAWGGIAAGIFGQSSLGGLGGVSFTVQLLGTLLGISVALIGAGIVYGAINRLSGLRLSQEDEFNGADLAIHKISSVNAE

SEQ ID NO: 10958 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 10959 - protein, 337 aa, Shewanella oneidensis MR-1
MTKRSIYVAYTGGTIGMQKTDNGFAPVAGFLTQCVQSMPEFYHAEMPEFVIHEYCPLIDSSNMAPTDWQMIADDINANYDKYDGFVILHGTDTMAYTASALSFMLQGLSKPVIVTGSQIPLAQLRSDGQTNLLNSLYIAANYPVAEVCLFFNNKLFRGNRSTKAHADGFDAFASPNFPLLLEAGIKINLRAGKIATPSNNPLEVANISPQPVGVVTLYPGISTQIFENILQQPVKALILLTFGVGNAPQDVALLRTLKQADERGIVLVNLTQCFQGKVNMGGYATGNALAKAGVISGADMTIEAALAKLHYLLSKNLKPIEIKTAMLQNLVGELSPD

SEQ ID NO: 10960 - protein, 494 aa, GIBBERELLA ZEAE PH-1
MTSSVTLQGAQGRQITVQTGLFIDNEFVPASNNATLDVENPNTATIIAQVSAAQASDVDRAVRSSQKAFATWGRSDPGTRRTLLLKLADLVEAHGPELASLEAIEGGLLYRDSLGLHVTQSVDNLRYFAGWADKLDGVSLPIPSGVAYTRREPIGVCAAIVPWNSLMILFWKLAPAIAAGNTIVIKTAELTPLWAQKAAELIKEAGFPPGVINIICGLGREAGQALAEHPVVRKIAFTGSSVTGRQIMQSAARSNLKKVSLELGGKGPSIVFADADWENALLWTTMGITASNGQICAAGSRIYVQDTIYEKFIQEFSRRSRDAVHGDPLLDETTKGAVASKAQLDKILSYVGKAKQTKARLLHGGQPLPGKGHFMANTAFVDVDQDDTIMREEIFGPFASIAPFSTEDEVIRKANDSDLGLNSAVFTNDVSRAFRISEAIETGTVTVNCWAMLNANTPFGGVKESGFGRDSGQEALDNWTVTKTVKFNILPPKL

SEQ ID NO: 10961 - protein, 122 aa, Triticum aestivum
  unsure (1)..(122): unsure at all Xaa locations
MAPTVMASSATSVAPFQGLKSTAGLPVSRRSNGASSAAXHNGGRIRCMQVWPIEGIKKFETLSYLPPLSTEALLKQVDYLIRSKWVPCLEFSKVGFIFREHNASPGYYDGRYWTMWXLPMFG

SEQ ID NO: 10962 - protein, 354 aa, Zea mays
MAPLGDGGAVAAAASNNLVVSFGEMLIDFVPDVAGLSLAESGGFVKAPGGAPANVACAIAKLGGSSAFVGKLGDDEFGHMLVNILKQNNVNSEGCLFDKHARTALAFVTLKHDGEREFMFYRNPSADMLLTEAELDLGLVRRAKVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAVPPRHCPPPPRPSSSTSSVSVH

SEQ ID NO: 10963 - protein, 300 aa, Glycine max
MAASSLNHKFHNHARSNSLPSKPHPLILQCNEHLARLGANDTISSSLLRQNLSSLLDLQECIEKLVQLPLTQEALLQERQEKWVDDLLDGSLRLLDACTATKDALLHTKECTRELQSTIRRRRGGEVELAVEVKKFLTSRKVVRKAIFKALENLKGNNNANKGNLAITNYKDYQTMALVNLLKEAEVVTFSIFESLLNFFSGSTQAKRISSWALVSKLMHNKRVATGYAQGADENEFAKVDAALQLFAFNMSTKSNDDISDLQKKLENLGTCIQDLEEGLESLFRRLIKIRVALLNILNH

SEQ ID NO: 10964 - protein, 179 aa, Glycine max
  unsure (1)..(179): unsure at all Xaa locations
MASSMISSPAVTTVNRAGAGMVAPFTGLKSMAGFPTRKTNNDITSIASNGGRVLCMQVWPPIGKKKFETLSYLPDLDDAQLAKEVEYLLRKGWIPCLEFELEHGFVYREHYRSXLEYYDGRYWTMWKLPMFGCTDASQVLKELQEAKTAYPNGFIRIIGFDNVRQVQCISFIAYKPPGF

SEQ ID NO: 10965 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 10966 - protein, 278 aa, Cladonia arbuscula
  unsure (1)..(278): unsure at all Xaa locations
VXHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 10967 - protein, 151 aa, Escherichia coli
GVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMG

SEQ ID NO: 10968 - protein, 568 aa, Azotobacter vinelandii
MARSTDVQRRKLSASSARHHLVRALLGRLYPLCHLEGARHTLPGQHHAPLSGGLDAPPAAARQPHRRRQRDRQPGAQRLLLRFQHPDHSRRHSHLAGFVRTGDFPAGRAAPRSGDHPRAVGNQAALPVRGVRLCLLHLQLVHAPVQFRRSAGRRRADGRRAARHRAGARGFRRARRTGDLAGRQPVQLRSARLLFRPGHAGLVHQPLGVHAGHGRRSHSALPPGVPFRGAGGHGLYADPAPGAPEGREVAFLSALDVPMKRLLTNPYLLLTLASLFWSGNMVMGRGLRGDLPPVGLAFWRWTIAFLLVLPLALPHLRKQWPALRAGWRPLLLLGVLGVGCYNTFSYIALQYTTATSAILLNSFIPVATIALAFLLFGKRLSRQEALGVIVSLAGALTLVVQGSLDRLLALSLNVGDLWMLAAVLSWGLYTVGLQWRPQGVHPMLLLAACIAVGLVAQVPAYAWEVAEGRSIVLNVQSVGGILYAGVVAAFLGFLCYNAGVAAIGPARGSLFIHLMPVFGTILSALLLGERPHLYHLAGIALVFAGIALTMRRPAVPGGVPLPAGESRP

SEQ ID NO: 10969 - protein, 328 aa, Shewanella sp. Bok-1-30-2
  unsure (1)..(328): unsure at all Xaa locations
CIGCHTCSITCKNVWTSREGVEYAWFNNVETKPGIGYPKEWENQDKYNGGWKRNKNGSLEPANGNRRRLLANIFANPDLPEIDDYYEPFDFDYQHLHNAPESKHQPVARPRSLITGQRMEKINWGPNWEEILGTEFSERKKDKNFDEVVQKEIYGQFEKTFMMYLPRLCEHCINPACVASCPSGAIYKREEDGIVLIDQDKCRGWRMCVSGCPYKKIYYNWKSGKSEKCIFCFPRIEAGQPTVCAETCVGRIRYLGVLLYDAERVDEVASVPNEHDLYPAQLSMFLDPSDPEVIAAAKAEGIPEHWLESARQSPVYKMAVDWTXALPL

SEQ ID NO: 10970 - protein, 216 aa, Brassica napus
DVSKFTVGDVVGVGVIVGCCGSCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLACLKLDGKLILMGVINTPLQFITPLVILGRKVIS

SEQ ID NO: 10971 - protein, 356 aa, Gaeumannomyces graminis
MSRAANPPSNSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDVGSRLDLLEKLLAFNPVKRITVEEALKHPYLEPYHDPDDEPTAPPIPEEFFDFDKHKDNLSKEQLKQFIYQEIMR

SEQ ID NO: 10972 - protein, 191 aa, Acetabularia cliftonii
MTGDVDMSLHPSGIIPELQNVVSTVNLGCTLELKEIAMQARNAEYNPKRFAAVIMRIRDPKTTALIFGSGKMVCTGAKSEQDSRTAARKYAKIVQKLGFPAKFTEFKIQNIVGSCDVKFPIRMEPLAYQHQQFCSYEPELFPGLIYRMLQPKIVLLIFVSGKVVLTGAKERTEIYRAFEQIYPVLTQFRKR

SEQ ID NO: 10973 - protein, 457 aa, Oryza sativa
MASPLLLLLPLAVSSLLLPFAAAARVFSVADYGAAGDGARYDTGAIQAAVDACAAAGGGRVLLPAPGDYLTATVHLRSRVVLDVAPGARLLGGTRQADYPPESRRWYVVLAENTTGAGVTGGGEINGQGGAFVVTPNPQKNIMVSWNATGDCEGDECRPRLVGFIDSKDVTIHDITLNQPAYWCLHIVRCDNTMIHNVSIYGDFDSPNSARGDIEDSNNTAITHCHIDTGDDAICPKSTTGPVYNLTATNCWIRTKSCAIKFGSASFFDFKKLVFDNITIVDSHRGLGMQIRDGGNVSDVVFSNIKMSTRYYHPLWWGRAEPIYITTCPRHPDSKEGTISDIQFINISSVSENGVFLAGSKHGLLRNLKFKNVDLTYKRWTNYSGGLYDYRPGCQKMVKHRTGGMMLEHISGLEIDNVRMRWSRGSLKGWDVDPLLFQPSTVDKLSFHDWQSLAVSR

SEQ ID NO: 10974 - protein, 224 aa, Triticum aestivum
MGEEANCDAVMEAGNGNGKAKENGHATAVVAMPDVKADDAVVAPADPRLQGISDAIRVVPHFPKQGIMFNDITTLLLRPGVFKDAVDMFVERYRGTGIAAVAGIEARGFIFGPAIALAVGAKFIPLRKPKKLPGEVISETYVLEYGTDCLEMHVGAIEPRERVLIVDELVATGGTLCAAINLLERAGADVVECACLIGLPKFKDCYKLNGKPVYVLVESLEYEK

SEQ ID NO: 10975 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVGATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 10976 - protein, 224 aa, Gossypium hirsutum
MAFVSEEEKTEDYLFKIVLVGDSAVGKSNLLARFARNEFYPNSKSTIGVEFQTQKLDINGKEVKAQIWDTAGQERFRAVTSAYYRGAVGALLVYDISRRQTFDSIGRWLNELQTHSDMNVVTILVGNKSDLRDAREVSTAEGKALAEAQGLFFMETSALDSSNVAAAFQTVVKEIYNILSRKVMMSHELKKQDAPLDGKTVVLQGDENQERATESPKSGGCCSS

SEQ ID NO: 10977 - protein, 514 aa, Chlamydomonas reinhardtii
MALKMRVSQRQALGSQTFVCPHGSVVRKAVSSKARAVSRQAQVVRAQAVSTPVETKVANGVAASSAAGTGQNDPAGDISKTVLGIILGGGAGTRLYPLTKKRAKPAVPLGANYRLIDIPVSNCLNSNVTKIYCLTQFNSASLNRHLSQAYNSSVGGYNSRGFVEVLAASQSSANKSWFQGTADAVRQYMWLFEEAVREGVEDFLILSGDHLYRMDYRDFVRKHRNSGAAITIAALPCAEKEASAFGLMKIDEEGRVIEFAEKPKGEALTKMRVDTGILGVDPATAAAKPYIASMGIYVMSAKALRELLLNRMPGANDFGNEVIPGAKDAGFKVQAFAFDGYWEDIGTVEAFYNANLALTDPEKAQFSFYDKDAPIYTMSRFLPPSKVMDCDVNMSIIGDGCVIKAGSKIHNSIIGIRSLIGSDCIIDSAMMMGSDYYETLEECEYVPGCLPMGVGDGSIIRRAIVDKNARIGPKCQIINKDGVKEANREDQGFVIKDGIVVVIKDSHIPAGTII

SEQ ID NO: 10978 - protein, 421 aa, Oryza sativa (japonica cultivar-group)
MQERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 10979 - protein, 118 aa, Zea mays
  unsure (1)..(118): unsure at all Xaa locations
KFYSVVLVFVRAAQYLFDFASREKQRLLLWLLXLXXIRQRRMQELMAQHGTQGKQGSQQNPDQERAQEDAKREADERRQMMLSQILSSQARERIARIALVKPEKARAVEDVXLRGCSN

SEQ ID NO: 10980 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 10981 - protein, 314 aa, Sinorhizobium medicae
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFP

SEQ ID NO: 10982 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVRQACKRGGKETKQIEEDGLVDVDGEKSKLAEDLSKIRMVESLDASASKELVDCAEEDRSDVTDCVQIVDIDSGVQDPQFCSLYAASIYDSINVAELEQRPSTSYMVQLQRDIDPTMRGILIDWLVEVSEEYKLVSDTLYLTVNLIDRFMSHNYIEKRKLQLLGVTCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNKTLQHYTRYETSALKNAVLAMEDLQLNTSGSTLIAIRTKYNQQKFKRVATLTSPERVNTLFSR

SEQ ID NO: 10983 - protein, 197 aa, Glycine max
MDSAATENMISPSHVVAITNGDASSSLDSGHARLLELGYKQQLKRDLSAISNFSLSFSVLSVLTGITTLYNTGLNYGGPVSMQYGWFIASGFTMRVAPALWLKFGHLYPTSGGLYYWSAKLAGPTWAPLASWITGWFNIVGQWAVTTSVDYSLAQLIQVIILLNTGGKNGGGYDVSTFSLIPFHGPRVPVPSPFLPL

SEQ ID NO: 10984 - protein, 245 aa, Populus tremuloides
MGRGRVELKRIENKINRQVTFAKRRNGLLKKAYELSVLCDAEVALIIFSNRGKLYEFCSTSNMLKTLERYQKCSYGAEEVNKPAKELENSYREYLKVKARFEGLQRTQRNLLGEDLGPLNTKDLEQLERQLESSLNQVRSTKTQYMLDQLADLQNKEHLLQEANRGLTIKLDEISARNSLRPSWEGDDQQNMSYGHQHAQSQGLFQALECNPTLQIGYNPVGSDQVSAITHATQQVHGFIPGWML

SEQ ID NO: 10985 - protein, 308 aa, Cicer arietinum
MAVPVIDFSKLNGEERAKTMAQIANGCEEWGFFQLINHGIPEELLERVKKVSSEFYKLEREENFKNSTTVKLLNDIAEKKSSEKLENVDWEDVITLLDNNEWPENTPCFRETMLEYRSELKKLAENIMEVMDENLGLPKGYIKKALNDGDEDNAFFGTKVSHYPPCPYPELVNGLRAHTDAGGVILLFQDDKVGGLQMLKDGEWIDVQPLPNAIVINTGDQIEVLTNGRYKSCWHRVLTSTDGNRRSIASFYNPPLKATISPAPQLAEKENQQVDDTYPKFVFGDYMSVYAEQKFLPKEPRFKAVKAI

SEQ ID NO: 10986 - protein, 81 aa, Glycine max
GSSMEMGAAITILIFSQYKLPVSTSMCISGATVGVGLCNGTFKAVNWQRVGLLFFSWVMTIPIAGLIGGITMGLFLNAPSY

SEQ ID NO: 10987 - protein, 462 aa, Streptococcus agalactiae 2603V/R
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 10988 - protein, 243 aa, Zea mays
MFGYRKADPDLEAGGSSLLYPGMTESPELRWAFVRKIYVILTVQLAMTAAVSAFVVKVPAVSNFFVSSNAGIALYIFLIVLPFIVLCPLHYYHQKHPVNLLLLGLFTVAISFAVGMTCAFTSGKIILEAAILTAVVVNSLTAYTFWAAKRGHDFNFLGPFLIAAIMVLMVFSLIQIFFPLGKISVMIYGGLASLIFCGYIIYDTDNIIKRHTYDQYIWAAVSLYLDVINLFLSLLQLLRAADS

SEQ ID NO: 10989 - protein, 308 aa, Escherichia coli
INGFGRIGRIVFRAAQKRSDIEIVAINDLLDADYMAIMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 10990 - protein, 243 aa, Zea mays
MHVTSGSPPPFCLHMHDAEQTQGLIDLAIKNNCLIGGDDFKSGQTKMKSVLVDFLVGAGIKPTSIVSYNHLGNNDIMNLSAPQTFRSKEISKSNVVDDMVSSNAILYGPGEHLDHVVVIKYVLYVGDRKRAMDEYTSEIFMGGKNTIVLHNTCEDSLLAAPIILDLVLLAELSTRIQLKPEGTDKFHSFHPVATILSYLTKAPLVPPGTPVVNALAKQRAMLENIMRACVGLAPENNMILEYK

SEQ ID NO: 10991 - protein, 69 aa, Zea mays
MFDKYGGMWHHSRVRKYLTSEDFAEAETDGRLWHGLALLLRKYPEHFVINIRKGGGLITEFVSLVSLQS

SEQ ID NO: 10992 - protein, 579 aa, Lactobacillus plantarum WCFS1
MAKISGSDAVLKVIQKWGVKHIYGLPGGSFDSTMNAIYNQRKTLKYIQVRHEEAGAIAASADYKLTGKIGVCFGSAGPGAVHLLNGLYDAKEDGIPMLAIVAQVPTKRMNMDFFQAMNEEPIFDDVAVWNRTAMTAESLPMMTDEAIRQAYAHNGVAVLTIPKDFGWAEIEDNFETNASVHTVNYPAPTAESVADAVKLIKAAKSPMIYFGVGAKDAAEELKAASEKFKMPLVSSVLAKGIIEDDYPAYLGSTGRVAPKPGAEIGFSTDLILWVGNNVPFSIFLFNKKAKVIQIDIDSEKFGKRHHTNVAIQADAKKALAAINAAGEARDDSAFYDAAVADKKNWDKWQASFNDSTESPVRPEPIFDVLNQEASDKAVWAIDVGNVNINFERLIRMHDDQKWATSGIYATMGFGVPAALAAKVNYPDRDVYSLSGDGAFAMLSEEILAQVKYNLHIINIVFSNETLGFIEAEQTDDSHQPLSGVDLPDTDWAKVGEGYGAVGYTVRTKAEFKQALEDAKKTDKPVVIDVKLTHAMPFTTEHMYLDDAWQDKDKIAEFVKKYDAQALKPFSYFLKQAQTN

SEQ ID NO: 10993 - protein, 399 aa, Wolbachia endosymbiont of Drosophila melanogaster
MQDAVLILQDGKCFWGKSVGKKGKCIGEVCFTTGMTGYQHTITDPSFADQIITFTFPHIGNIGINHKDNEGKKIFASGVVMRELSSMSHPSSYISLNDWLEKNNVIGISGVDTRALTRHLREHGSQNGMICSSSKAHALDKLKEYKPVNGIEITNKVSLNNSFENNRLAEHFVIQVADYSDPAKNIWIPVSRTGMTSDRAIDLNAKYRIVIVDFGVKISIVSRLIELGCTVELIRPSTGFAQKVLSMNPDGIVLSNGPGDPQEIGESVVSEIDIIIKSKIPIFGICMGHQLLAITLGAKTIKMDIGHRGSNHPVYDVISGKVEITSQNHGFVVDSASLPSNVEITHISLFDNSVEGIMMKDYLVFSVQYHPEEAPGTHDSHYLFRRFIGNIVLYKMKSA

SEQ ID NO: 10994 - protein, 879 aa, Oryza sativa
MGMVLGKITVETPKHEVLHTGAGYEVRKYPPCVVAEVTYDPAEMKGDRDGGFTVLGNYIGALGNPQNTKPEKIDMTAPVITSGEPESIAMTAPVITSGEPEPVAMTAPVITAEERSQGKGQMTMQFLLPSKYSKVEEAPRPTDERVVLRQVGERKYGVVRFSGLTGDKVVKEKAEWLKAALEKDGFTVKGPFVLARYNPPFTLPPLRTNEAGRRDRIWPILVSGAAPFRFNVGPTKRSDPYPQGCNPVYGFGRNPTSLTVAKPFNANWIESNTFVFYQASHRRREPAMAMAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQNNAHDIQVYFMSAATEVVKGKVLPKQLTGFSVFSFSWKNVSATWRLPLLYSFEELCLPIDFHGRDASV

SEQ ID NO: 10995 - protein, 423 aa, Rhodospirillum rubrum
MDQITEFQLDINRALKETLALVLAGGRGSRLRDLTNRESKPAVPFGGKYRIIDFPLSNCMNSGIRRMCVITQYRAHTLIHHIQRGWGFLRAEIGEFVELWPAQQQTDKESWYLGTADAVHQNLDLIRMHDPRFVLILAGDHIYKQDYSKLLAHHIARGSDCTVACVDVPREEATGYGCVEVDNDDNIVHFLEKPANPPGIPGRPDRAFASMGIYIFNADFLYEILESDALNEASQHDFGRDIIPSQVGKARIVAHRFSQSCVYSVGRREPYWRDVGTVDAYWSANIDLVSVTPALDLYDADWPIWTYQMQRPPAKFVFDTDERRGMAKDSLVSAGCIVSGGAVTGSLLFNDVRVNSYSSVIDTVILPMGDIGRHARLTKCILDTGCRIPEGLVIGEDPILDAKRFHVTEQGITLVTPDRLALL

SEQ ID NO: 10996 - protein, 504 aa, Ralstonia metallidurans
MTRCLHCVSDHRRRLHRVAPFRSLSELRGCPLRGSGQSFSQSLTGRRQPSSATSAEADASQVDRAVQAARAAMEGPWGNTSAAERARVLHAVADGIERRFDEFVAAEVADTGRTEQQARALDIRRGVLNFRTFADLASQAGGDYFDMRTAEGDVFSYTVRKPHGVVGIISPWNLPMLLMTWKVAPALACGNAVVVKPSEETPGSATLLAEVMHEAGVPAGVFNLVHGFGGGSAGEFLSRHPGIDALTFTGESRTGSTIMKAVADGVKEISFELGGKNAAVVFADCDFDKAVAGVMRSSFTNTGQVCLCSERVYVERPIFERFVAAMKARAEALRIGYPTVEGVEMGSLISRNHRDKVLSYYALAREEGATVVTGGGVPHFGDARDNGAYVQPTIWTGLPDSARCIQEEIFGPVCHIAPFDTDAEVVKRVNDSRYGLAASVWTRDLARAHRVTRQFDVGIVWVNTWFLRDLRTPFGGTRLSGIGREGGRHSLDFYSSLTTICVNP

SEQ ID NO: 10997 - protein, 467 aa, Oryza sativa (japonica cultivar-group)
MADEKLAKLREAVAGLSQISDNEKSGFISLVARYLSGEEEHVEWAKIHTPTDEVVVPYDTLAAPPEDLEETKKLLNKLAVLKLNGGLGTTMGCTGPKSVIEVRNGFTFLDLIVIQIESLNKKYGSNVPLLLMNSFNTHEDTLKIVEKYTNSNIEVHTFNQSQYPRVVADEFLPWPSKGKTCKDGWYPPGHGDIFPSLMNSGKLDLLLSQGKEYVFIANSDNLGAIVDMKILNHLIHKQNEYCMEVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 10998 - protein, 492 aa, Ipomoea batatas
MDPSKYRPSSSFNTPFCTTNSGAPVWNNTCALTVGSRGPILLEDYHLVEKIQNFTRERIPERVVHARGASAKGFFEVTHDITHLTCADFLRAPGVQTPLIVRFSTVIHERGSPETIRDPRGFAVKMYTRGGNWDLVGNNFPVFFIRDGTQFPDVIHAFKPNPKSHIQENWRILDYLSHLPESLNTFAWFYDDVGIPTDYRHMEGFGVHTFTMINKEGKANYVKFHWKPTCGVKCLLEEEAIRIGGENHSHATQDLYESIAAGNYPEWKLYIQVMDPDHEDRFDFDPLDTTKIWPEELIPLQPVGRMVLNKNIDNFFAENEMLAMDPAHIVPGIYFSDDKMLQARVFAYADTHRHRLGPNYMLLPVNAPKCAHHNNSYDGYMNFVHRDEEVDYFPSKFDNTRNAERFPTPLRIVTGQRDKCVIEKENNFKQPGDRYRSWAPDRQDRFINRWVKALSEPRVTHEIRSTWISYLTQADRSLGQKVASRLNIRPTM

SEQ ID NO: 10999 - protein, 500 aa, Staphylococcus epidermidis ATCC 12228
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 11000 - protein, 573 aa, Chlorobium tepidum TLS
MHNNGEKLIGSEIFFECLRRENVEYIFGYPGGALLKVYETLHDVEDIEHILARHEQGATHMAEGYARATGRPGVVLVTSGPGATNTVTGITNAYMDSTPLVVFTGQVPSSLIGNDAFQEADIVGITRPITKHNFLVKDVRELATTIRKAFYLATNGRPGPVLVDMPKDVLNAECTFEWPENVDIRGFKPTIKCHANQVSKAAKMIAKAKRPLFYVGGGVISAEASAELRKLAIDQQIPVTMTLQGLGAFPGDHPLSMGMLGMHGTYWANQAVSNCDLLIAVGARFDDRVTGKVDTFATHAYKIHNDIDPTNVDKNIKVDLPVVGDSKDFLASLIEAMPKSREDRSAWLAEIEKWRKQCPLDYEIEPDSLKTEFVIDEVSRQTKGHAVVVTDVGQHQMWTSQYYKFTEPRSIITSGGLGTMGFGLPSAIGAAFGVTDRPVLLFSGDGGLMMNIQEMVTAVYNKLPIKIFLINNSYLGMVRQWQELFHQEKYTFTDLASSNPDFVKVAEAFGCKAMSASNPEAARAAITEALAYNDGPVLVDFRVIRKDMVFPMVPAGGSISDMLLARLNPKTMV

SEQ ID NO: 11001 - protein, 526 aa, Citrullus lanatus
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 11002 - protein, 396 aa, Streptomyces coelicolor A3(2)
MTASTVSTDVPGATDVPVMPADERTHRHVPPEGSHRHPQVDPLAALRTPQDPPWDVYLTGTVFLDVIFTGLDSAPVRGTESWARGMGSSPGGIANMATALARLGLRTSLAAAFGDDHYGDYCWDALAQGEGIDLSPSRTVPGWHSPVTVSMAYEGERTMVSHGHEPPPEEPSPDCPPRARAAVASLTPGVRAPWIAQAAARGTRVFADVGWDDTGAWDLAGLPDLAHCEAFLPNAEEAMRYTGATCPRAAAHALTEHVPLAVVTLGADGAYAVDRRTGESAEVPAIEVEALDPTGAGDVFVAGFVTGTLAGWPLADRLAFAGLTAALSVQEFGGSLAAPGWCEIATWWRKVQSVESQDPTALRRYAFLADLVPDAQPGSWPLRRAVPTIGFRRPTP

SEQ ID NO: 11003 - protein, 122 aa, Triticum aestivum
  unsure (1)..(122): unsure at all Xaa locations
LKSTAGLPVSRRSNGASLGSVSNGGRIRCMQVWPIEGIKKFETLSYLPPLSTEALLKQVDYLIRSKWVPCLRFSKLXHLXXEHNASPGYYDGRYWAMWNCLCSGCTDATQVINEGGGVKKDT

SEQ ID NO: 11004 - protein, 455 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 11005 - protein, 342 aa, Ralstonia metallidurans
MPAMMKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVVADPNYVGLLPKNVDFIEIAPILCAGVTVYKGLKVTDTRPGQWVVISGIGGLGHVAVQYARAMGLRVAAVDIDDAKLAFARKLGAEVAINARTTDPAAFLQKEIGGAHGVLVTAVSPQAFSQAIGMVRRGGTISLNGLPPGDFPTPIFDVVLKAITIRGSIVGTRSDLQEALEFAASGVVKATVSTEKLDSINSIFDRMKAGQIEGRIVLDFSR

SEQ ID NO: 11006 - protein, 198 aa, Synechocystis sp. WH 8501
MILVIDNYDSFTYNLVQYLGELGFKWPVASDIQVYRNDKIDIPKIRHLNPDGIVISPGPGRPEDSGVSLALLQELGPTVPILGVCLGHQSMGQVFGGKVVSASILMHGKTSPIYHNDQGVFQGLDNPFEATRYHSLVVERETLPHVLEITAWTEDGTIMGLQHKDYPHLQGVQFHPESILTTSGKSLLENFLKVLNPQ

SEQ ID NO: 11007 - protein, 317 aa, Zea mays; identical to SEQ ID NO: 6344

SEQ ID NO: 11008 - protein, 199 aa, Ceratopteris pteridoides
RNGLLKKAHELSVLCDAEIALIIFSSTGKLFEHSSSRGIKKILERYKRCSGILQDVGGTVIRDVEYWKQEAERLKERLTYMEEIQRNMLGESLGSLQIKDLQNLEAKLDSGLYKIRGAKTQLMVRQVQELQKKEQILLQQNEALRTKLAELSRLQAPVSGLTTATTSQDVQESSSGSGSRQHETSLSAAETTLQLGFAQ

SEQ ID NO: 11009 - protein, 561 aa, Glycine max
  unsure (1)..(561): unsure at all Xaa locations
MSTHIESLWVLALASKCIQENIAWSLLIIMVTLWLTMTFFYWSHPGGPAWGKYYYFNYWKKTTSTNTNINLKMIIPGPRGYPFIGSMSLMTSLAHHRIAAAGEACKATRLMAFSMGDTRDIVRGHPHVAKEILNSSNFADRPVNKSPYSLMLNRAIGFASYCVYWRSLRRIASIHLFCPRQIKASELRRHDPNSGMEELAILVDQGYDLLGLFDWAXRCLFMHISTPKISGSGATTSSAGEPFRPHIIADTELVKPKPIVIFSALCALSMLVEQGYDLLGTLNWGDHIPFLKDFDLQKIRFTCSKLVPQVNRFVGSIIADHQADTTQTQPRSRASLASXPTRPDKLSHSDMIAVLWEMIFRGTDTVAVLIEWILARMVLHPEVQRKVQEELDAVVRGGALTEEVVAATAYLAAVVKEVLRLHPPGPLLSWARLAITDTTIDGYHVPAGTTAMVNMWAIARDPEVWLDPLEFKPERFMGLENEFSVFGSDLRLAPFGSGRRTCPGKTLGLSTVTFWVAWLLHEFEWLPSDEAKVDLTEVLRLSCEMANPLIVKVRPRHGLST

SEQ ID NO: 11010 - protein, 395 aa, Chlamydophila caviae GPIC
MQRNNNFSKLETSYLFSSIRQKIRAFREAHPDVSIIDLSIGDTTQPLHTAVMDTFTKSVQKLGNPETYRGYGPELGLSTLREKLSEVFYQGKVSPEEIFISDGAKMDIFRLLSLFGPGKTIAVQDPSYPVYIDTALLAGAKKVIKLPCRKETDFFPVIPQGEEIDIFCLCSPNNPTGTVLTKEQLEELITYANSHGSIILFDAAYSAFISDPSLPKSIFEIPEARSCAIEINSFSKSLGFSGVRLGWNVVPKDLRYSNGLPIIDDWKRFLHTTFNGASLPVQEAAITGASLFPNLEAIAHYRHNSSLLREALQKAEFSVYGGEHAPYLWVEVPKILPDEDFFDFFLTQYHIAITPGKGFGACGKGYVRFSSLGKIEDIMAACQRLTLTSVYDRMV

SEQ ID NO: 11011 - protein, 613 aa, Chlorobium tepidum TLS
MSLAALGVVFGDIGTSPLYAIRECFHGEFSIPVNTPNVLGVLSLLIWALLLIVTLKYLTFIMKADNEGEGGILALTALIISHSKKNKSERWILVSLGLFGAALLYGDGMITPSISVLSAVEGIQIIAPSFGPLVIPVTIAILAGLFLFQHHGTAKVGSFFGPIILLWFTSIGLCGLVEIVKYPAILKAVFPWYGLEFLVNNHAKGFLVLGAVFLAVTGAEALYADMGHFGRRPIRLTWSLLVLPALLLNYFGQGAVLLSEPAKSWNPFYALVPSWGIIPMVILATLATIIASQALITGIFSLTQQGIQLGYIPRLTVQHTSASHIGQIYVPAANWALMFSTIALVAGFGSSSKLASAYGVAVTATMLISAVLFYYVARDLWNWNRLGLNLLMGMFMLIDLSFFGASVSKLFHGAWFPLVIGFALFTLMLTWKQGRLLLMKQIQDRTLTVSEFTESLAIQQPQRVKGQAIYLTANPDVVPMALLHNMRHNKILHSEVGLLHFSTERVPRVPNSKKVEVIQLNYGMYKIIARYGFMEYPNIRQVLALANQQGMHFRTDAISYFINREKIVTGMKSKMSVWRKKLFALMARNALSATAYYDLPSGQVIEIGVQVQI

SEQ ID NO: 11012 - protein, 293 aa, Enterococcus faecium
MKVKKAVIPAAGLGTRFLPATKAMAKEMLPIVDKPTIQFIVEEALDSGIEDILIVTGKEKRPIEDHFDANIELENNLREKEKTELLALVEETTQVNLHFIRQSHPRGLGDAVLQAKAFIGNEPFVVMLGDDLMKDDIPLTQQLMMDYEETQASAVAVMRVPENETSKYGIIDPKTDSEKGRCRVKGFVEKPEMGKAPSNLAIIGRYLLTPKIFEILETQEPGAGNEIQLTDALQTLNQTEAVYAREFKGKRYDVGDKLGYMKTNIEYGLQHSEIGTSLSAYIIQLSKKLRTES

SEQ ID NO: 11013 - protein, 290 aa, Pseudomonas aeruginosa PAO1
MVASKEPIMSQSERRFSFEFFPAKTEAGHEKLLATARNLAGYKPDFFSCTYGAGGSTRDRTLSTVLQLDGEVKVPTAPHLSCVGDSKAELRELLGRYREAGIRRIVALRGDLPSGMGMASGELRYANELVDFIRTETGDHFHIEVAAYPEVHPQARSFEDDLANFVRKVKAGASSAITQYFFNADAYFYFVERVAKLGVDIPVVPGIMPITNYSKLARFSDACGAELPRWIRKQLEAYGDDSRSIQAFGEQVISEMCERLLEGGAPGLHFYTLNQADPSLAIWKNLQLPR

SEQ ID NO: 11014 - protein, 446 aa, Triticum aestivum
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 11015 - protein, 161 aa, Funaria hygrometrica
MDFVVFDTDPFLTTLHQLVHEPGSDLERKIKRQRRNHHDEPRHVTIATPVDVKEIKDAYLFVADVPGLQKTDIEVQVENENVLTMRGKRKLDEKVNEKEEDTKFIRMERSPVKLLRKFTLPSDANADAITANCVDGVLTVTVPKIPPPEPAKSKTVQIAVD

SEQ ID NO: 11016 - protein, 229 aa, Glycine max
  unsure (1)..(229): unsure at all Xaa locations
FGTRKLFVHTIYPEHEDKSDFDPLDVTKTWPEDMIPXQPDGRWVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRFWAPDRQDRFARRWVDALSDPRVTHEIRSVWISYWSQADRSLGQKIASHLSTRPNI

SEQ ID NO: 11017 - protein, 519 aa, Schizosaccharomyces pombe
MLIFVSMAGWMFGADTRSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 11018 - protein, 335 aa, Thermoanaerobacter tengcongensis
MGVRVGINGFGRIGRNVFRAALKKNADLEFVAVNDLTDAKTLAHLLKYDSVLGKFEGEVSYTDDSLIVNGKEIKIFKETDPGKLPWGDLGVDIVIESTGRFTNKEDAIKHIHGGAKKVIITAPAKNEDVTIVMGVNEHMYDPANHHVISNASCTTNCLAPIAKVLNDKFRIKKGMMTTVHSYTNDQRILDLPHSDLRRARAAAVSIIPTTTGAAKAIHLVIPELKGKMNGFAMRVPTPNVSVVDLVAEVEIPTTVEEVNAAMKEASETYMKGILGYSEDPLVSVDYKGDDRSSIVDAPLTMVVEGTLVKVVSWYDNEWGYSNRVVDLALYIAERM

SEQ ID NO: 11019 - protein, 806 aa, Oryza sativa (japonica cultivar-group)
MPVADCESGLSPADVTGAGAANGNPGHWRSYYRHVLLLAYQSCGVVYGDLSTSPLYVYKSTFIIGSLRRFQDEEIVFGVFSLVFWTLTLIPLLKYVFIVLAADDNGEGGTFALYSLLVRHAKFSLMPNQEAADEELTSYYRPGYAPQETPILTALRRFLENHRKSRTFLLVTVLFGASLVIGDGVLTPPMSGERAYRNTTTTWCVVWVADVIDDRSFVLAAGWAVLSSFSGLQVHSTALTSGEVEILSCTVLVCLFMVQHWGTHRVAFLFAPVVIVWLLLLGALGVYNIVVWNPRVLRALSPYYLVRDRSHVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVVPRPSDLARTGLLMREPGEEESVVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 11020 - protein, 257 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTANQHCRYVERCKFPQDGSSPKSLRYIGSLVA

SEQ ID NO: 11021 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 11022 - protein, 302 aa, Vibrio vulnificus CMCP6
MQLQGFTMKSRFENALASAPESLSRHLAPIILAADFDASLSTVQFDELLKQTGMTDNQLRVALLPFAAAYSYAPISEFYVGAIVRGLSGALYFGANMEFDGVQLGQTVHAEQSAISHAWMKGEQGLSDITINFSPCGHCRQFMNELSSAKELKIQLPEREEKKLHDYLPDSFGPSDLGIESALMSQVHHGFATEDDDALMQRAVEAMNRSHAPYTHNLSGVALQTESGRVYLGAYAENAAFNPSLPPLQVALIQLLLAGERFENIQSAALVESHKGKISHLACTQSTLEALNPDIPVSYLSL

SEQ ID NO: 11023 - protein, 477 aa, Glycine max
MDAKSAVELMESSSEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTKQLLRVMDKLKHGEAVDIPKYDFKSYKSDDVLRRVNPSDVIILEGILVFHDPRVRELMNMKIFVDTDADVRLARRIRRDTTEKGRDIGAVLDQYSKFVKPAFDDFILPTKKYADIIIPRGGDNHVAIDLIVQHIRTKLGQHDLCKIYPNLYVIQSTFQIRGMHTLIRDAKTTKHDFIFYSDRLIRLVVEHGLGHLPFTEKQVITPTGSVYTGVDFCKRLCGVSVIRSGESMENALRACCKGIKIGKILIHREGDNGQQLIYEKLPNDISDRHVLLLDPILGTGNSAVQAISLLIKKGVPESNIIFLNLISAPKGVHVVCKSFPRIKIVTSEIEIGLNEDFRVIPGMGEFGDRYFGTDDDDEQVVVSSQ

SEQ ID NO: 11024 - protein, 433 aa, Vibrio parahaemolyticus RIMD 2210633
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 11025 - protein, 177 aa, Streptococcus mitis
TSVMFDGSHLPVEENLDKARKVVEFAHANGVSVEAEVGTIGGEEDGIIGDGELAPIEDAKAMVETGIDFLAAGIGNIHGPYPANWKGLHLDHLQKLTEAVPGFPIVLHGGSGIPDEQIQAAIKLGVAKVNVNTECQIAFANATRKFARDYEANEAEYDKKKLFDPRKFLADGVKAIQ

SEQ ID NO: 11026 - protein, 496 aa, Pseudomonas aeruginosa PAO1
MTDLRDTSRDERLLAAHGYRQELERGLSLWSSFSVGFATISPVVGIYSVMSLGAMSMGPSWVWVVPLCLLLQFGVALVYAELSSQFPLAGGCYQWVRRLVGDRLAWFTGFLYLASALASLTTVAYLGGFWLGLLATGAPPSANGQVLCGALLLALGLAVNLLGINPLKYFVNAGIVAEAIASIGIGVLLLLFFRNHPLDLLFSGPGGTGDADGSYLDGVLTALAVGGWAFLGFDACSQISEETTDARVSTPRAILRSMLVVGFTVMLTAFAVTLSYQDIGAVVSGQVVDPVTPAVVDAFGAWAERPFVAVVLIAFVACVVSVQTYIGRAIFGMARDAILPGSALLRRVDRRKVPMAAMVCSTLLASLGLALGLNATAVGTLIAFGSGGFFVVFLIVAACALWARLVGRWDPDKGALRLGRAGLAVNVLAVAWLSFEALNVAWPRASLAPPDAPWFQVWAVVVVFSALAAFGLLYMVIAKPHRRIATSLSFAAPPAD

SEQ ID NO: 11027 - protein, 411 aa, Vibrio vulnificus CMCP6
MGCCDAPGLMPIEDAMEKMLSRIKPIQTTLKLPLAEALGYVLAEDILSPINVPPFDNSAMDGYAIRIADLEHNQPLPLAGKSFAGQPFDGEWPQNSCIRIMTGAKIPAGCDAVIMQENTEVSDEGIVIQQCQIKPNENIRPTGDDIQAGDLVLAQGARLTPRDIPMIASLGISHVTVVRKPRVAFFSTGDELKSLGEPLLEGQIYDSNRYGIKPLIENFGCEAIDLGIIPDCPETLKATFEKAQSLADVVVTSGGVSVGEADYTKDILEQLGEIGFWKLAIKPGKPFAFGKLSTAWFCGLPGNPVSAVLTMYVLVQPMLAKLAGHSQWKAPESIPATTRTAFKKAPGRTDYQRGIYTIENGQFFVETTGNQSSGAFRSMSLANCFVVLERERGRVEVGETVNIELFNSTLF

SEQ ID NO: 11028 - protein, 489 aa, Zea mays
MDARIILVVKKKKKKKKKKKKKRHASAAPPPSALRCPLASAPERQSLLAPAPPPPRGVGQTLAHRTRRPARSHSPPPPMAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 11029 - protein, 332 aa, Magnetospirillum magnetotacticum
MASKKKDRGAAEPTPQELIRYYREMLLIRRFEEKAGQLYGMGLINGFCHLYIGQEAVVVGMQAVAGAADSCITSYRDHGHMLVCGMDPKGVMAELTGRAGGYSRGKGGSMHMFSREKRFYGGHGIVGAQVPLGTGLGFAHKYSKDNGVAHVYCGDGAVNQGQVYEAFNMASLWKLPVVFVIENNKYAMGTSTIRHAAGQELYMRGAAYGIPGEPVNGMSVIAVREAAARALEHARSGQGPYILEMNTYRYRGHSMSDPAKYRSKEEVTKMREQHDPIDQLKEKLLADGLIDEAGLKEIDREVKVIVTEAAEFSQSSPEPDPSELWTDVLIEA

SEQ ID NO: 11030 - protein, 106 aa, Glycine max
  unsure (1)..(106): unsure at all Xaa locations
QRTCTRLITVTGYSDAQADVIESDGVSTXDGYQKHLAYLNSNGDAGADMIVTHLFYDTDIFLNYANDCPQIXITSPIVPGNMPIYYYKGFIRMTAFCITNIPADII

SEQ ID NO: 11031 - protein, 317 aa, GIBBERELLA ZEAE PH-1
MSFHPDNLPSLNGKVFIVTGGNAGMGYYTVLHLAAHGAHVYMCCRSLEKGNAAIAEIKKEHPSANIDLLQMDLMDFSSTVAAAKHFLTRETSLHGLINNAGIMATPFDMTKDGHEAQWQTNYLSHWVFTEHLIPVMQRTAKTLPPGSVRIVNLTSSGHLGAPKTGINFDDLTLKDQGVWERYGQGKLANILHTKSLHNKYGPGSENKDGEIWVTAVHPGLVETNLATTVDPTEKGMLTLVSALRCFRMLWTADKGSWNSLYCAASQDMKAEQSGQYMEIFHRFGEPWWASSAAKDEELAKKLDVWTRETMGKEGWVQ

SEQ ID NO: 11032 - protein, 86 aa, Triticum aestivum
MSQEKEEARGGKSETLNPRIPKPSIRSDPTRPAAMASAPVEKLKSLWNSQVMDEEQWAVNYRVLKAAGIFAGSIFLMRAFGDMMVV

SEQ ID NO: 11033 - protein, 297 aa, Zea mays
QATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGETEEPAGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQAC

SEQ ID NO: 11034 - protein, 393 aa, Triticum aestivum
MDAGGAQPPDSEMAEAGAGAAAAAGTAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 11035 - protein, 334 aa, Saccharomyces cerevisiae
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELFSEEEEMLQKCKETLKKNIEKGVNFVASK

SEQ ID NO: 11036 - protein, 310 aa, Staphylococcus piscifermentans
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSDEKAKAHIDAGAKKVLISAPATGDVKTIVYNVNQDTLDSSDVIVSGASCTTNSLAPVAKVLNDSFGLVEGFMTTIHAYTGDQNTQDGPHRKGDKRRARAAAQNIVPNSTGAAKAIGKVIPEIDGKLDGGAQRVPVATGSLTELTVVLDKEVSVDEVNEAMKQASNESFGYNEDEIVSSDVVGMTFGSLFDATQTRVMTVSGRQLVKVAAWYDNEMS

SEQ ID NO: 11037 - protein, 256 aa, Zea mays; identical to SEQ ID NO: 7692

SEQ ID NO: 11038 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 11039 - protein, 815 aa, Xylella fastidiosa Dixon
MERRTARHRPQRLRHSISPSHWPGSKLEHRPTATLGTVTSTEARAKFNLTGGPGKDHPRYAGLTLWSPNINIFRDPRWGRGMETYGEDPYLTSQLAVSFIRGLQGNIPDHPRTIATPKHFAVHSGPEPGRHSFDVDVSAYDLEATYTPAFRAAIVDGHAGSVMCAYNALHGTPACASDWLLNTRLRNDWGFNGFVVSDCDAIEDMTRFHFFRQDNASASAAALKSGDDLNCGNTYRDLNQAIARGDIDESTLDQALIRLFTARQRLGTLQPREHDPYAAIGIKHIDTPAHRALALQAAAQSLVLLKNSGNTLPLTPGTTLAVLGPDADSLTALEANYQGTSSTPVTPLIGLRTRFGTAKVHYAQGASLAPGVPSTITETALRNHGHPGLKGEYFDTIDFSGPPHLVRQDRIIAFNWDHVAPAPGMNPHRYAVRWTGELLPPGPGTYTFAVHVARCFDCNGHDPVRLYIDDRQIIPDNATAAQATTAPQQTDNTHLEATLHFTDTRPHHIRLDMEHRGEDQGVRLEWLAPEAPQLAEAERAVAHADAIVAFVGLSPEVEGEELHIDTPGFSGGDRTTIDLPATQETLLQHVKTTGKPLIVVLMSGSAVALNWAQHHADAILAAWYPGQSGGTAIAQALAGDVNPGGRLPVTFYRSTQDLPPYISYDMTGRTYRYFKGQPLYPFGYGLSYTQFAYEAPQLSTATLKAGDTLTVTAHVRNTGTRAGDEVVQLYLEPPHSPQAPLRNLVGFKRVTLRPGESRLLTFTLDARQLSSVQQTGQRSVEAGHYHLFVGGGQPNTGAPGGTAAFSIIGRALLPK

SEQ ID NO: 11040 - protein, 163 aa, Saccharomyces cerevisiae
DAENWTPVEGGFQYAKDLIKYIKSKYGDHFAIRCGYPECHPELPNKDVKLDLEYLKQKIDAGDFIITQMFYDVDNFINWCSQVRAAGMDLPIIPGIMPITTYAAFLRRAQWANLHPSTFLVRLDPIKDDDELVRDIGTNLIVECVKIARQWLRSHLHIYTMNL

SEQ ID NO: 11041 - protein, 506 aa, Ralstonia eutropha
MNMAEIAQLGVSNPYKQQYENYIGGAWVPPAGGEYFESTTPITGKPFTRVPRSGQQDVDAALDAAHAAKAAWARTSTTERANILNRIADRIEANLKLLAVAESIDNGKPVRETTAADLPLAVDHFRYFAGCIRAQEGGISEIDADTIAYHFHEPLGVVGQIIPWNFPLLMATWKLAPALAAGNCVVLKPAEQTPASILVLMEVIGDLLPPGVVNVINGFGLEAGKPLASSPRISKVAFTGETTTGRLIMQYASQNLIPVTLELGGKSPNIFFEDVLAADDAFFDKALEGFAMFALNQGEVCTCPSRALIQESIYDRFMERALKRVAAIRQGHPLDTGTMIGAQASAEQLEKILSYIDLGRKEGAQCLTGGERNVLDGDLAGGYYVKPTVFAGHNKMRIFQEEIFGPVVSVTTFKDEEEALAIANDTLYGLGAGVWTRDGARAFRMGRGIQAGRVWTNCYHAYPAHAAFGGYKQSGIGRENHRMMLDHYQQTKNLLVSYSPNALGFF

SEQ ID NO: 11042 - protein, 210 aa, Asarum europaeum
GGLLKKARELAILCDAQLGVIIFSSSGKMFEFSSPPISMREIIDRYQKLSGNCAPVYDNQQVYCEITRMKNEIDKLQATMRHFAGEDLTSLTMNEMLQLEQQLEISVNKVRSRKEQLLQQQLDNLRRKENMLEEQNRELYRVIQDHHAASMEQKMVDPSMLDHFGVFYQDDHQAARSSMLQLSPQLHPFRLQPAQPNLQDANLLPHDLQL

SEQ ID NO: 11043 - protein, 454 aa, Haloferax volcanii
MTEDNALTDGGLSDEAQAVIDEIEEKNVDFLRLQFTDILGTVKNVSIPASQAEKAFTEGIYFDGSSIDGFVRIQESDMRLEPDPSTFAVLPWRKKENSAAGRLICDVFNTSTGEPFSGDPRGVLKRAIEPEELGYDVNVAPEPEFFLFEEDEDGRATTVTNDAGGYFDLAPKDLASDVRRDIIYGLESMGFDIEASHHEVAEGQHEINFTYDDALSTADNVRTFRSVVRAIAAEHDLHATFMPKPIPRINGSGMHTHISLFKDGENAFHDGDDEFDLSDTAKSFVAGILDHAPAITASLTRRSTPTRRLVPGYEAPVYIAWSDRNRSALIRKPAARTPAASRIEARFPDPSCNPYLAFAALIHAGLDGVEKGLDCPDPVRENIYEFDEAKREEYGIETLPKTSAARRRPRRDEVIQEALGDHVFEKFVEAKRSEFKDYLVDVSQWELDRYLETF

SEQ ID NO: 11044 - protein, 271 aa, Arabidopsis thaliana
SSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYT

SEQ ID NO: 11045 - protein, 126 aa, Zea mays
  unsure (1)..(126): unsure at all Xaa locations
VSAQNVWIXKGGASLGEISAEQLVDIGCQWVILGHSERXHIIGENDEFIGKKAAYALSQNVKVIACIGELLEEREAGKTFDVCFRQKKAFAGETSSSXEVHAAVRNWLKTNISHDVASSTRIIYGG

SEQ ID NO: 11046 - protein, 103 aa, Mycoplasma genitalium
KKTAILDHFDYDLILENALIQKNKLQEHKEIEDIANLAHIFFVRQKNQDGLGDAILFAESFVGNEDFAVLLGDDVVFSKEPALKQCLEAYYETNCQTIGVQEV

SEQ ID NO: 11047 - protein, 572 aa, Pseudomonas syringae pv. syringae B728a
MSKTIADHLAQTLAAAGVSHIWGVSGDSLNGLTDSLERTDSIRWMHTRHEEVAAFAAGAQAASSGKLAVCAGSCGPGNLHLINGLYDCHRNRVPVLAIAAHIPSSEIGLDYFQETHPQELFKECSHFVELVSNPEQFPRVLERAMRAAISQKGVAVIVLPGDVALSDAPDVAAKWIEATAPKVVPAENDLQSMADMLNASKAVTLLCGAGCEGAHEQLLALADTLGAPIVHALRGKQHVEYDNPFDVGMTGLIGFSSGYHAMLSCDTLVILGSSFPYRNFYPEKADIIQIDLDPTQIGRRTPVALGLVGGVRDTLEALQPKLKPHTDRRFLDKALKHYAKAREELDELATPTPDGAPIHPQYLTRLVDEQADADAIFTVDVGTPTLWAARYLHMNGKRSLLGSFNHGSMANALPQALGAKAEHPDRQVIALCGDGGLSMLLGDLLSIRQLNLPIKMVVFNNSSLGFVDMEMKASGYVPHGTDLHETNFAGIALGAGILGLRVENAEELPAALRKAFDHPGPVLIDVVTAKQELGIPPKIKLAQARGFSLYMMRAIMSGRGSEVLELAKTNLR

SEQ ID NO: 11048 - protein, 156 aa, Zea mays
  unsure (1)..(156): unsure at all Xaa locations
ADTNATTTNAGAPVWNXNEALTGGPHGPILLEDYHLIDKWLHFSRERIXPERVVLRARGLRQGFFXCTHYVTTVTCADLLRAPGVREPVIVLFSRXIHYEXLGDKRTRAFQQKFTARANCDLLDNNFPVFFMRDSIKIRHVIHAIKPNLRTNLTRI

SEQ ID NO: 11049 - protein, 400 aa, Pyrococcus furiosus DSM 3638
MSIRLPQEGKVIEVVNGSLKIPNEPIVAYIEGDGIGREVIPAAIKVVDKAVETAYKGKRRIVWWKLLAGKEALQKVGKLLPEETVKGIAEVKVALKGPMETPIGTGHRSINVALRKMFDLYANIRPIKYYGVPTVYPYADKVDLIIFRENTEDVYAGIEWEAYSREAQKLREFLKNEFGIEIREDSGITLKPISKFATQRIVRKAIKWAIEKGRKRVTIMHKGNVMKFTEGAFRNWAFEVAEKEFSEYVSIGKPEEGKILVDDKIADNMLQQIILRPWEYDIIVTPNLNGDYLSDAAAALVGGVGMAAGINVGDYIAIAEPVHGTAPDIAGKGIANPSAAILSAALLLEYLGWVEAAELIRASLRKTIEKGKVTPDLARGEKALSTEEFIQEVIKEIEGE

SEQ ID NO: 11050 - protein, 493 aa, Ferroplasma acidarmanus
MKIYIDGTWKESSNGNTLNKYNPSTGEVLDTFPAATKDDIDAAMDSAESAFPSWSDMGTQERAKILYKAVELISQKRGELENLLTLEVGKIKREAIDEVDGVIDQIQYYAEFERKLTGDIVEGSSSKRKIFQYKVPYGIVVAITPWNFPAAMVVRKLAPALLTGNTVILKPSSDTPLTANWIVNKFIEAGIPKGVLNFVTGRGSEIGDYIVNHKKVGLVTMTGSTSTGQKIMQNASSNMAKLILELGGKAPFIVWKDADMIRALKSLIWAKYLNVGQSCIAAERLYIHEDIYDKFMSKFVAITKKLTTGDPDTSDVGPLINKNALAGMVQTVNNAKDSGYKILTGGNTPDLQGKYKNGYFFAPTIIENVPQDSGLFQDEIFGPIIGTEKISGVDEMYRKANDSKFGLASYLFTEDPELMLEASEKIRFGELYINMPGPEASQGYHTGFRMTGQAGEGSKYGINEYLKLKNVYVDYSKKALYINTINNSLFDNL

SEQ ID NO: 11051 - protein, 573 aa, Haemophilus influenzae Rd
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 11052 - protein, 323 aa, Glycine max
MAGIFSLVTGRPGLSGFGSSSTAEQVTEGIDASNLTAIITGGASGIGLETARVLAIRKVHVIIAARNMESAKEAKQLILQEDESACVDIMKLDLCSLKSVRTFVDNFIALGLPLNILINNAGVMFCPYQQTEDGIEMQFATNYLGHFLLTNLLLDKMKQTAKDTGIEGRIVNLSSIAHLYTYEEGIRFDTINDEDGYHEKKAYGQSKLANILHTNELSRRLQAEGVNITANSVHPGVIMTPLMRHSSLLMNFLKMFSFMIWKNVPQGAATTCYVALHPSLKGVTGKYLQDCNESPPSAHASNELLGRKLWDFSNKMINSLSKA

SEQ ID NO: 11053 - protein, 306 aa, Streptomyces roseochromogenes subsp. oscitans
MKTISLSEHEVRAAVSMREAIDAVRRGFAGLARGEFEMPTRTALRDGRFLVMSAHHRPTRSAMVKTLSVNFDRAPAITGTVVWSTLDRLDHLIADAGAVTTLRTGAAVGVATDLLAAPDADRLTLIGTGGQAPDQVRAVHTVRPLRRLTVVGTTEERARSLADTLRAELDGTEIRVGTDPASAVGDAHIVCCATSATSPLFPASALPAQVHVNAIGAFRPTMRELPDELLADSTVIIDELGAVLEESGEIIHALRAGALSQDDLTELGTALTSAPAGHGKRTVFKSVGVAMQDWTIARLLADKFLG

SEQ ID NO: 11054 - protein, 509 aa, Avicennia marina
MFIESFKVDSPNVKYTDSEIHSVYNYETAELVHENRNGTYQWIVKPKTVKYEFRTDTHVPKLGVMLVGWGGNNGSTLTGGVIANREGISWATKDKVQQANYFGSLTQASAIRVGSFNGEEIYAPFKSLLPMVNPDDIIFGGWDISNMNLADAMGMGQGLDIDLQKQLRPYMEHMVPLPGIYYPDFIAANQGSRANNVIKGTKKEQVQQVIKDIKEFKEKTKVERVVVGTANTERYSNVVVGLNDTAESLMASLERNEAEISPSTLYAIACVLEDVPFINGSPQNTFVPGLIELAIQRNCLIGGDDFKSGQTKMKSVLVDFLVGAGIKPTSIVSYNHLGNNDGMNLSAPQTFRSKEISKSNVVDDMVASNSILYEPGEHPDHVVVIKYVPDVGDSKRAMDEYTSEIFMGGKSTIVMHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 11055 - protein, 342 aa, Triticum aestivum
  unsure (1)..(342): unsure at all Xaa locations
MSSSSPPNSNDSGKKNPLDAMGAFFSAQVNRRKLVSTQKLAMSERCTSCGDEFPGCAHRPADRKTWMAELGPDRLRVHQVVWPGTHDSATNKIGIPFITRPFAQCQSLSVYHQLALGCRLLDVRVQEERRVCHGVLATYSVDVVLDDVLRFLAETVSEVLVLEIRTEFGREDPPDFAKYLVERLGEHLRRLXLPQDEAVFGKTVAELLPRRVICVWKPRKSPAPGRGEPLWSSGYLRDNWIDTDLPETKYESNLKFLGQQPPARDRRYLYRVENTVTPQADNPVVCVRPVTNRIRGYARSFIAEAFAKGLGDRLQVFSTDFIDGDFVDACAGVTKARVDGAA

SEQ ID NO: 11056 - protein, 115 aa, Zea mays
HVDYACTPEEVQQHFNSCGTVNRVTILTDKFGQPKGFAYVEFVEVEAVQEAIKLNESELHGRQLKVAPKRTNVPGMKQPRGRGFNPYRPYGYSPYGYGYGYGRFPRFRRPRRPYF

SEQ ID NO: 11057 - protein, 421 aa, Hydrogenobacter thermophilus
MLKVESVYRWEGSLKVPQEGKFIKLKEDKSIEVPNFPIIPFIEGDGIGAEIMPAMIHIVNTAVEKAYGGSRNIFWVELLAGDKAEEKTGKRMPEETIEFLKEAVVGIKGPLGTPVGKGGKSLNAILRQSMDFYSAIRPVYWLGQPAPIPNPERVNVAVFRENSDDVYMSIEYMPKEERTQKVRKFFIEEMGVSEYALPEDCGITVKPMSEFKTKRHVRKALRWALQNNKKVVAVVGKGNIMKATEGAFMNWAFEVAKEPEFEGKVITEGEPKDGQVLMVKVITDQMLMQLVLKPEAYHVIITQNLNGDYISDLASALVGGPGFVPSGNIGDGYALFESTHGTAYDIAGKGIANPLSLTLSGAMMLEYLGWKEASELIYSAVKRTIAERLGTPDIANGFRKQGLEAKELTTLEFAKAIADRI

SEQ ID NO: 11058 - protein, 339 aa, Clostridium tetani E88
MNYIKFDEKKPLDVIPIGRVTIDFNPNEINRPLEESRTFTKYLGGSPGNIAVGLARLGKKVGFLSTVSDDQFGNFVVNYLKNEGIDISQINRAKNGEKLGLTFTEILSPKESSILMYRKGIADLQLSSKEVSEDYIKSAKAIVISGTALSKSPSREAAFVALEYAKKHNTRIIFDLDYREYTWNCKEEIAIYYSLAARMSDVIMGSREEFNLMEGLISPEESNDKETAERWIGYGNKIVVIKHGKDGSTAYLHDGTSYKIKPFPVKLLKSFGGGDAYASAFIYGIMEGWDVIDALEFGSASAAMLVASHSCSEAMPKVEEIKQFIKEKKEEHGEMVVRG

SEQ ID NO: 11059 - protein, 375 aa, Medicago sativa
MKSNFHSSTTMNVFLFMSLLFCSTFHVSLSLIDGLVANGNFELGPKPSELKGTVVTGGKNSIPEWEISGLVEYIKSGQKQGDMLLVVPEGAYAVRLGNEASIKQRIKVIKGMYYSITFMVARTCAQEERINISVAPDFGVIPIQTLYTSSGWDPIAYGFKAEYDVVEMVIHNPGVEEDPACGPLIDSVALRTLYPPKASNKNILKNGGFEEGPYIFPNTSYGVIIPPNIEDDHSPLPGWMVESLKAVKYLDSGHFSVPQGTRAVELVAGKESAIAQVARTIPGKTYVLSFSVGDASNSCEGSMIVEAFAGKDTIKVPYSSKGKGGFKRAALKFVAVGTRTRVMFLSTFYSMRSDDLSSLCGPVIDDVKLLSVRKA

SEQ ID NO: 11060 - protein, 160 aa, Clostridium difficile
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEA

SEQ ID NO: 11061 - protein, 82 aa, Glycine max
  unsure (1)..(82): unsure at all Xaa locations
MNLGWADILDLIIXQIETLNSKYGSRVPLLXFNKDDIHDSSLKVLEKYSKSSVEVHTFKQGEDRELKSLGEYYSKEEVYVIL

SEQ ID NO: 11062 - protein, 394 aa, Synechocystis sp. PCC 6803
MSLNWISRADRLQALPPYVFARLDELKAKAREQGLDLIDLGMGNPDGKAPQPIIEAAIAELENPESHGYPPFEGTQSFRQSITRWYARQYGVDLDPDSEALPLIGSKEGLGHLALAYVNPGDLVLVPTPSYPAHFRGPLIAGAEIYPIMLSAKDDWLIQLDQIPEAIAQRAKILYFNYPNNPTTATAPREFYEAITDWARHYQIMLVHDLCYAELAFDGYQPTSLLEIPGAKDFSVEFHTLSKTYNMAGWRVGFVVGNQEIIQGLRTLKTNLDYGIFRVVQKAAETALSLPESYIEVVRKRYQERRDFVINGLSKLGWSITPSQATMYLWVPCPVGMSSTDFALTVLEKTGVVMTPGNAFGEGGERYVRLSLIADGDRLGEALQRIEQAGIRYS

SEQ ID NO: 11063 - protein, 415 aa, Polysiphonia harveyi
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIASTGEVKGHYMNITAATMEEMYERAEFGKQIGTIIVMIDLVIGYTAIQTMAVWARKNDMILHLHRAGNSTYSRQKIHGMNFRVICKWMRMAGVDHIHAGTVVGKLEGDPLMIKGFYNTLLETHLDINLPQGIFFQQDWASLRKVAPVASGGIHCGQMHQLLDYLGNDVVLQFGGGTIGHPDGIQAGATANRVALESMVIARNEGRDYVTEGPQILRDAAKTCGPLQTALDLWKDITF

SEQ ID NO: 11064 - protein, 399 aa, Clostridium tetani E88
MLGVSKRVEELRFSEIRKFIPYSDGAKAKGVQVHHLNIGQPDIKTPEEFISAIKNFDEEIVKYEDSQGNKDLIDAFVKYYESINIDIDKEDVYITNGGSEAILYALLTICDLGDSVIVPEPYYTNYNTMAKMAGVDIISFRTYREDGFRIKSKEDIINSIKDNTKAIMITNPSNPTGVVYTKEEIRMISDIAKEKDLFIISDEVYREFVYDDLKFTSFMDMKDILDRVIIIDSISKRYSACGARIGALICKNRNVTENFMKMCQARLSVSSLDQVGAANLINVPKSYIEEVRIEYEKRRNILYEGLCDIPGVHCEKPSGAFYIIAKLPIDNSDDFTKWMLKDFQYNNKTVMVTPAEGFYTTEGLGKDEVRLSYCINSQDLKESMLILKKALEEYNKLRK

SEQ ID NO: 11065 - protein, 473 aa, Leptospira interrogans serovar lai str. 56601
MSRTPSEVIAYAKANNVLFYDFRFTDIKGAWHHVSYHAGSINEDSFKGLPFDGSSIPAWQPIDRSDMQLIPDTSAIFLDPFTADSTLVVFCDVFDIYKGTLYEKCPRSIAKKALKYLESSGLADTAYFGPENEFFIFDNIKVRDAINVQYYEIDSSEGIWNSHTDFPGSTNTGHRPGTKGGYFPVAPVDSQVDLRADIVKTLHQIGMETFVVHHEVAQGQGEIGVKFGTLIEAADNVQKLKYVVKMVAHKYGKTATFMPKPLYGDNGNGMHCHQSIWKNGVNLFAGKGYQNLSDTAMHYIGGVLSHAKSCAAFTNASTNSYKRLLPGFEAPSILAYSAQNRSASCRIPFVNGDKARRVEFRFPDSSANPYLAFAAMLMAGIDGVQKKIDPGPPREEDLFELSLDEIREKGIQQMPHTLRESVEHMLLDKEFLKKGDVFTEEFIQTYKAYKFETEIWPWEGRPHPFEFLTTYSC

SEQ ID NO: 11066 - protein, 206 aa, Ralstonia eutropha
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 11067 - protein, 302 aa, Zea mays
MAGMSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMVLLNGGVFGVILLLTLLLFKGSKRVVLLGWICVGFSVSVFVAPLSIMRRVIQTKSVEYMPFSLSLSLTLSAVVWFLYGLLIKDKYVALPNILGFTFGVVQMVLYVLYMNKTPVAATAEGKDAGKLSSAADEHVLVNIAKLSPALPERSSGVHPVTQMAGVPVRSCAAEATAPAMLPNRDVVDVFVSRHSPAVHVA

SEQ ID NO: 11068 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPTPEDPELDQFMEDYCKLLVECKEELSRPLQEAEEFL

SEQ ID NO: 11069 - protein, 445 aa, Aglaothamnion byssoides
FRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAANMEDMYERAEFAKQLGTVIIMIDLVIGYTAIQTMGIWARKNDMILHLHRAGNSTYSRQKVHGMNFRVICKWMRMAGVDHIHAGTVVGKLEGDPLMIRGFYNTLLDSHLDICLPQGIFFEQDWASLRKVTPVASGGIHCGQMHQLLDYLGNDVVLQFGGGTIGHPDGIQAGATANRVALESMVIARNEGRDYVAEGPQILRDAAQTCGPLQTALDLWKDITFNYTSTDTADFVETPTANV

SEQ ID NO: 11070 - protein, 446 aa, Salmonella enterica subsp. enterica serovar Typhi Ty2
MPQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDEPPQETRFLQLFNRRHFPFVLFVAAIWSCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 11071 - protein, 329 aa, Pseudomonas putida KT2440
MRAVKNLLVLYTGGTIGMLETPEGLAPAGGFEARMREHFAQMANAPQVQWTLHELNPLLDSANMQQHNWLAMRDAIVAAVDVAGHDGVLVLHGTDSMAYSAAALSFLLLDLPAPVVLTGSMLPAGVPDSDAWDNLCGALRQFEHGLEDGVQLYFHGQLLHGCRASKLRSEAFDAFAALPRHRDAERADTIPAELGYKQPRKPVNLAVVPVFPGLQAGHLQALIDSGVQGLLLECYGSGTGPSDDQALLNVLSTARQRGVMLAAISQCPEGSVVFDTYAAGNRLRGAGLVSGGGMTREAALGKMVALLGAGLDADAADRWFVLDLCGERA

SEQ ID NO: 11072 - protein, 686 aa, Bacillus circulans
APDTSSSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDVVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTATWEGGSNHTFTAPSSGTGTINVNWQP

SEQ ID NO: 11073 - protein, 68 aa, Zea mays
ACLQEQALDERISDIREKLRGLTEDENNQRWLYVTEDDIKGLPSFQNETLIAIKAPHGTTLEVPDPDE

SEQ ID NO: 11074 - protein, 386 aa, Aspergillus parasiticus
MTGLDMEIIFAKIKEEYARTDDVGKRQIQGHIRELQVGFYSDWDVVMRLSSGPLQVALTKVGIDLGIFRSLKESDTPITLAEIVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHYPVLEELGGFPAPDKVLMVDIGGGFGQQSKALRAKFPDLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQVGLEIIQSKVYDSKEQAILVAVPKRT

SEQ ID NO: 11075 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 11076 - protein, 358 aa, Glycine max
METRAAAKRKANAATIVFVEKQYPNKRQRVVLGELPNLQNLIVSETQNSRKEKLLCRKNPNEKKPSPTNNNTFPSPQINESYDSDIHGYLREMEMQNKRRPMVDYIEKVQKIVTPTMRAILVDWLVEVAVEYKLLSDTLHLSVSYIDRFLSVNPVSKSRLQLLGVSSMLIAAKYEEMDPPGVDEFCSITDHTYDKTEVVKMEADILKSLMFEMGNPTVSTFLRRYADVASNDQKTPNLQIEFLGSYIGELSLLDYDCLRFLPSIVAASVIFLAKFIICPEVHPWTSSLCECSGYKPAELKECVLILHDLYLSRKAASFKAVRAKYKQQKFECVANLPTPPYVPSCYFEDQWCSEFLDK

SEQ ID NO: 11077 - protein, 335 aa, Novosphingobium aromaticivorans
MAIKVAINGFGRIGRNVARAILERPDCGLELVSINDLADAKANALLFKRDSVHGAFSGEVSVDGNDLIVNGKRIQVTAERDPANLPHGANGIDIALECTGFFTNRDGGQKHLDAGAKRVLISAPAKNVDLTVVYGVNHDKLTGDHKIVSNASCTTNCLAPMAKVLHESIGIERGLMTTIHSYTNDQKILDQIHSDPRRARAAAMNMIPTSTGAAVAVGEVLPDLKGKLDGSSIRVPTPNVSVVDLTFTPKRDTSVEEVNGLLKAAAEGALKGVLGYTDEPLVSIDFNHDPHSSTIDSLETAVLEGKLVRVLSWYDNEWGFSNRMLDTAGAMAKFL

SEQ ID NO: 11078 - protein, 357 aa, Leuconostoc mesenteroides subsp. mesenteroides ATCC 8293
MTSVKKIVVLKGDYIGPEIMTAGLAVLDAATKDTTFAYELIDAPFGGDGIDRAGDPLPQSTIDVSKQADAVLLSAIGGPKWDNAPRRPEQGLLEIRSKLNLFANIRPTKVTAAQIDRSPLKPEYVENTDFVIVRELTSGAYFGKPRKLEAHQAIDTMYYSEEEVTRIMHQGFKMAQKRNKHVTIVDKSNVLATSKFWRKIANEVGKSYQDVTIDYYYVDAMTMAIMAKPTTFDVVIIPNLFGDILSDEAAQITGSIGQIPSMSVGESGPNLYEPIHGSAPDIAGQGIANPISMVNTVAMMLTESFDEKRIADKITAAVDYIIENHCVTPDMGGTMTTDEVTQKMVDYIKNYESADIK

SEQ ID NO: 11079 - protein, 306 aa, Escherichia coli O157:H7
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 11080 - protein, 183 aa, Zea mays
MASQRIFQLGLRRAAAPGLRVQPAGRMVQRRLAATEHASQSQAAEILAKQRINRPVSPHLAIYRPQITWIASGLNRITGLTLSGSLYLFGIAYLIAPYTGWHLETQSMVAAVAAWPAVVKAGVKTFFALPFFFHCLNGGQHLAWDMGVGFKNQQVIRTGWGGCGIDSRLDPLLCFPGINELRL

SEQ ID NO: 11081 - protein, 454 aa, Hypnea chordacea
GYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIKGFYNTLLLPYLEINLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 11082 - protein, 101 aa, Saccharomyces cerevisiae
MSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGATY

SEQ ID NO: 11083 - protein, 100 aa, Triticum aestivum
  unsure (1)..(100): unsure at all Xaa locations
IAVNKEGESISNIPANSVNAVTWGVFPGKEIIQPTIVDSASFMVXKDQAFEIWFRGWACLFPQDNSSRELLEQIHKSYWLVSLVDNDYISGHIFAAFEEV

SEQ ID NO: 11084 - protein, 347 aa, Glycine max
  unsure (1)..(347): unsure at all Xaa locations
LAYVSRESRVVGAGDLVDHPKRIALHYLKGYFLIDLFVVFPLPQIMILXVLPNSLEGANYAKNLLRAAILVQYIPKLFRFLPLLIGQSPTGFIFESAWANFIINLLIFMLASHVVGSCWYLFGFQRVNQCLRDACHSSNIPGCMKFIDCGRGHGKNQPSLRSDQWINNTDAVACLDPSPDGFSYGIYENAVPLTIETNIVNKYVYSLFWGFQQISTLAGNLEPSYFVWEVLFTMAIIGMGLLLFAILIGNIQNFLQALGRRKLEMQLRGRDVEQWMSHRRLPEDLRRRVRQAERYNWAATRGVNEEMLMENLPEDLQRDIRRHLFKFVKKIRLFALMDEPILDAILE

SEQ ID NO: 11085 - protein, 337 aa, Staphylococcus aureus subsp. aureus Mu50
MIYIDKNESPVTPLDEKTMTSIISATPYNLYPDAAYEQFKEAYAKFYGLSPEQIIAGNGSDELIQKLMLIMPEGPALTLNPDFFMYQAYAAQVNREIAFVDAGSDLTFDLETILTKIDEVQPSFFIMSNPHNPSGKQFDTAFLTAIADKMKALNGYFVIDEAYLDYGTAYDVELAPHILRMRTLSKAFGIAGLRLGVLISTAGTIKHIQKIEHPYPLNVFTLNIATYIFRHREETRVFLTMQRQLAEQLKQIFDTHVADKMSVFPSNANFVLTKGSAAHQLGQYVYEQGFKPRFYDEPVMKGYVRYSIATASQLKQLEEIVKEWSAKYDLSKTTKHS

SEQ ID NO: 11086 - protein, 405 aa, ASPERGILLUS NIDULANS FGSC A4
MLFRTAWARQAAPLRRQAFAPLARRSVTTDAASSHAENIPEDENKPFTVRLSDESFETYEIDPPPYTLEVTKKELKQMYYDMVAMRRMEMAADRLYKEKKIRGFCHLSTGQEAVAVGIEHALTREDKIITAYRCHGYAMMRGGTIRSIIGELLGRREGIAYGKGGSMHMFAPNFYGGNGIVGAQVPVGAGLAFAQQYNEEKSTSVVLYGDGASNQGQVFEAFNMAKLWNLPVLFGCENNKYGMGTSAARSSALTDYYKRGQYIPGIKVNGMDVLATKAAVKYGKDYAISGNGPLVYEYVTYRYGGHSMSDPGTTYRSREEIQRMRSTQDPIQGLKQKILDWGVMSEEDLKGLDKSARAHVDEEVAIAEKMPLPENNSRILFEDIYVRGSEPRWMRGRTVDETFYY

SEQ ID NO: 11087 - protein, 190 aa, Listeria monocytogenes EGD-e
MILIIDHNDSFTYNLYQYFLELQEEVQVVSATSFSLEAFQQLAPEMVVLSPGPGSPEDFPVSLALLGKIQVPILGICLGHQIIGHFFGAKVVPANVPVHGKTSVISHTGEGLFADLEPAFQVTRYHSLVIDPTTVPVNLKVTAVTEDGVIMGLVHATKPIHSVQFHPEAILSENGHAILKNFVRLGRNVK

SEQ ID NO: 11088 - protein, 690 aa, Nicotiana tabacum
MQDFIGSVRRSLVFKQSGDFDTGAAGVGSGFGGFVEKLGSSIRKSSIGIFSKAHVPALPSISKAELPAKARKDDTPPIRWRKGEMIGCGAFGRVYMGMNVDSGELLAIKEVSIAMNGASRERAQAHVRELEEEVNLLKNLSHPNIVRYLGTAREAGSLNILLEFVPGGSISSLLGKFGSFPESVIRMYTKQLLLGLEYLHKNGIMHRDIKGANILVDNKGCIKLADFGASKKVVELATMTGAKSMKGTPYWMAPEVILQTGHSFSADIWSVGCTIIEMATGKPPWSQQYQEVAALFHIGTTKSHPPIPEHLSAESKDFLLKCLQKEPHLRHSASNLLQHPFVTAEHQEARPFLRSSFMGNPENMAAQRMDVRTSIIPDMRASCNGLKDVCGVSAVRCSTVYPENSLGKESLWKLGNSDDDMCQMDNDDFMFGASVKCSSDLHSPANYKSFNPMCEPDNDWPCKFDESPELTKSQANLHYDQATIKPTNNPIMSYKEDLAFTFPSGQSAAEDDDELTESKIRAFLDEKAMDLKKLQTPLYEGFYNSLNVSSTPSPVGTGNKENVPSNINLPPKSRSPKRMLSRRLSTAIEGACAPSPVTHSKRISNIGGLNGEAIQEAQLPRHNEWKDLLGSQREAVNSSFSERQRRWKEELDEELQRKREIMRQAVNLSPPKDPILNRCRSKSRFASPGR

SEQ ID NO: 11089 - protein, 389 aa, Arabidopsis thaliana
MALSRLSSRSNIITRPFSAAFSRLISTDTTPITIETSLPFTAHLCDPPSRSVESSSQELLDFFRTMALMRRMEIAADSLYKAKLIRGFCHLYDGQEAVAIGMEAAITKKDAIITAYRDHCIFLGRGGSLHEVFSELMGRQAGCSKGKGGSMHFYKKESSFYGGHGIVGAQVPLGCGIAFAQKYNKEEAVTFALYGDGAANQGQLFEALNISALWDLPAILVCENNHYGMGTAEWRAAKSPSYYKRGDYVPGLKVDGMDAFAVKQACKFAKQHALEKGPIILEMDTYRYHGHSMSDPGSTYRTRDEISGVRQERDPIERIKKLVLSHDLATEKELKDMEKEIRKEVDDAIAKAKDCPMPEPSELFTNVYVKGFGTESFGPDRKEVKASLP

SEQ ID NO: 11090 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 11091 - protein, 458 aa, Oryza sativa (japonica cultivar-group); identical to SEQ ID NO: 9999

SEQ ID NO: 11092 - protein, 314 aa, Rhizobium tropici
VMFDGSSIAGWKAINESDMVLMPDPDTVHMDPFFAQSTMVILCDILDPISGESYNRDPRGTAKKAEAYLKASGIGDTAFFGPEAEFFVFDDVKYKADPYNTGFKLDSSELPSNDDTDYETGNLGHRPRVKGGYFPVPPIDSCQDMRSEMLTVLTEMGVTVEKHHHEVAAAQHELGIKFDTLVRSADGMQIYKYVVHQVANAYGKTATFMPKPIFGDNGSGMHVHQSVWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 11093 - protein, 298 aa, Saccharomyces cerevisiae
MSTNAKESAGKNIKYPWWYGGAAGIFATMVTHPLDLAKVRLQAAPMPKPTLFRMLESILANEGVVGLYSGLSAAVLRQCTYTTVRFGAYDLLKENVIPREQLTNMAYLLPCSMFSGAIGGLAGNFADVVNIRMQNDSALEAAKRRNYKNAIDGVYKIYRYEGGLKTLFTGWKPNMVRGILMTASQVVTYDVFKNYLVTKLDFDASKNYTHLTASLLAGLVATTVCSPADVMKTRIMNGSGDHQPALKILADAVRKEGPSFMFRGWLPSFTRLGPFTMLIFFAIEQLKKHRVGMPKEDK

SEQ ID NO: 11094 - protein, 355 aa, Claviceps purpurea
MSRANPPNAGGSRKISFNVSEHYDIQDVVGEGAYGVVCSAVHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPPRVLFPKTSDLALDLLEKLLAFNPVKRITVEEALKHPYLEPYHDPDDEPTAPPIPEAFFDFDKHKDNLSKEQLKLLIYEEIMR

SEQ ID NO: 11095 - protein, 211 aa, Zea mays
GDWDPRGRPGDSQPLTVAILASLLFGESIGAIGVGGLVLGVVGLLLLEVPALSVEGNDTTIWGSGESLMFLSAQSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSTVQIGGALLTLVAIYMVNYKSIIGEK

SEQ ID NO: 11096 - protein, 171 aa, Oryza sativa
RLYRQRSRGFAVKFYTEDGNWDLVGNNTPIFFVRDPILFPSFIHTQKRNPATHLKDPNMVWDFFTLRPESTHQAMFLFSDRGTPDGYRFMNGYGSHTFKLINAKGEAVYCKFHLKSGQGIKNLPVDKAAKISGDDPDYSIRDLYNAINNGDYPKWNFFIQVMTFEQAEKHR

SEQ ID NO: 11097 - protein, 372 aa, Triticum aestivum
  unsure (1)..(372): unsure at all Xaa locations
MSGGVDPETPPSSGGSATGSPMARKPPRHQLTAIRHCASSARIAAASTDLGLDSGTLSLISPADIRPTFLPVFRSGSCANIGPKSYMEDEHVCIDSLIEHLGMRTPAIPAPGAFYGVFDGHGGTDAVCFVRKNLLKFIIEDGHFPNSMEKAIRSAFVKADHAIADSHSLDRNSGTTALTGLIFGRTLXLVANAGECRAVXGKRGRAVELSKEHKXPSCKSEKLRIENLGGIVFDGYLNGQLSVARAIGDWHVKGSKGSISPLTPEPEFQEVRLTEEDEFLIIGCDGLWDVMTSQCAVSMVRKELMAHNDPERCSRELVQEALRRDTCDNLTAVVVCFSADPPPQIEVPRFRVRRSISMEGLHMLKGALDSNA

SEQ ID NO: 11098 - protein, 197 aa, Triticum aestivum
MSEVFEGYERQYREISAALSRKCAAASALDGEKKKQKLPEIQADVQESESLIRKMDLEARSLQPTVRAGLLSKLREYKSDLNNIKSEIKKVSAPNAQQATREELLDSGMPDTLGASSDQRGRLMMTSERLNQSSDRIRESQITALDTEEIGVSILQNLHNQRETLMHAHKTLHGVDDSIGKSNKILASMSKWNKWFV

SEQ ID NO: 11099 - protein, 388 aa, Archaeoglobus fulgidus DSM 4304
MQSGDISWLLISTALVVLMTPALGLFYGGMVRAKNVLSTITMCFVALAIVSVQWILLGYTIAFGDDVSGLTGNLVFIGLRNVSMSDYGFVAFQMAFAAITLAIIVSALAERVKLSAFLLFGILWTTFVYDPIAHWVWGGGWLAGIGALDFAGGTVVHISSGFSALALALLVGRRTGYGEYNIEPHNIPMTLLGTALLWFGWFGFNAGSALEANDVALNAFLVTNTSAAMGALSWMFASWLKGKPGSLGVASGAIAGLVAITPAAGYVDPLSALVIGGVAGVVCYAAMLLRVRAGVDESLDAWAVHGVGGLWGAIATGIFASVGATGLVAGNAQQLLLQIIAALVATAYAFLVTLILAKAVDAAVGLRVSSQEEYVGLDLSQHEEVAYT

SEQ ID NO: 11100 - protein, 436 aa, Saccharomyces cerevisiae
AVSKVYARSVYDSRGNPTVEVELTTEKGVFRSIVPSGAATGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 11101 - protein, 323 aa, Glycine max
MVGIFSLITGRPGCSGFGSSSTAEQVIEGIDASNLTAIITGGASGIGLETARVLAIRKAHVIIAARNMESAKEAKQLILEEDESARVDIMKLDLCSVKSVGTFVDNFIALGVPLNILINNAGVMFCPYQQTEDGIEMQFATNHLGHFLLTKLLLDKMKQTAKDTGIEGRIINLSSIAHVYTYEEGIRFDNINDEDGYSDKKAYGQSKLANILHTNELSRRLQAEGVNITANSVHPGVIMTPLMRHSSLLMNFLKMFTFFAWKNIPQGAATTCYVALHPSLKGVTGKYFRDCNECQPSTHASNELLGRKLWDFSNKMINSLSKA

SEQ ID NO: 11102 - protein, 646 aa, Methanosarcina acetivorans C2A
MKRKEFRELVPVEEARRIINRLQIRPEKENSALENAYGKILAEDIVTEINVPPFSRATMDGYAVRAEDTYACSETEPVKLKLLGNIPAGSDVSFKVSAGEIVEIATGAPIPEGADAVVMVEYSSEENGTVLIFRPVAGGENVMKAGSDILKGGRVLRRGRKLGTREIGVLASIGKKEVPVLRLPVGIISTGNELVSPGGNLAPGKVYDANSYTLYTGVQECGAFSLLYGVVKDDETGIRKALETAVSECALILTSGSTSSGTGDVMYRIIDEVGETLAHGINIKPGKPVVIGIIKGVPIIGLPGNPSSALMIFNEFVAPFLRKALGAEAGVRRTETGILGTVLRSEGRQQLLPVGLVRGRVYPADRGSGAITSLSEADGFIEIPPETEYMEAGTAVEVTLFGEVEKPDLLIAGGFCPGLDVLEDLSGLRFRTLYTGSSGGFSAIAAGTADIAGVNMPSKRPENRRESLPGEIRYNAPTIENMGLSEVVLVKGYRREMGLLVQQDSPVSGLEALPGKRLINRNRGSGTRALLELKIEELAEKKGISKKEFTDSIPGYGSGAKSEVSVCEAVLSGKVDAGVGLRNCAERNGLKFVKFAEEEYDFLIRKEVLDVPEVRKFLKTLSSAEFASKLPAGLQVYERTGEIISY

SEQ ID NO: 11103 - protein, 391 aa, Zea mays
MRMEGAGGGAGGGGAGAGGCLGMGHGGEAQIKGTHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFRVRFPTMSSGAMDLLERMLVFDPSKRITVDEALCHPYLASLHEVNDEPICPAPFSFDFEQPSLTEEAIKELIWKESLKFNPDPIH

SEQ ID NO: 11104 - protein, 445 aa, Gelidium floridanum; identical to SEQ ID NO: 7947

SEQ ID NO: 11105 - protein, 536 aa, Zea mays
  unsure (1)..(536): unsure at all Xaa locations
GDLYTTLAVVRSVTDAIYFLHMLLQFRLAYVAPESLVVGAGDLVDEAGGXAIHYFRGYFLLDFFDVLPLPQVMILLVVPKVGLSAANYAKNLLRVTVLLQYVPRIIRFVPLLDGQSTNGFIFESAWANFVINLLMFILAGHVVGSCWYLFGLQRVNQCLRDACSISTIPYCDSFIDCGRGIGSGLYRQQWFNDSGAEACFNTGNDATFQYGIYEQAVLLTTEDSAVKRYIYSLFWGFQQISTLAGNLVPSYFIWEVLFTMAIIGLGLLLFALLIGNMQNFLQALGRRRLEMQLRRRDVEKWMSHRRLPEDLRRRVRRAERFTWAATQGVNEEELLSNLPEDIQRDIRRHFFRFLNKVRLFTLMDWPILDAICDKLRQNLYISGSDILYQGGTVEKMVFIVRGKLESISADGSKAPLHDGDVCGEELLTWYLEHSSANRDGGKIKFQGMRLVAIRTVRCLTNVEAFVLRASDLEEVTSQFARFLRNPRVQGAIRYESPYWRTIAATRIQVAWRYRKRRLKRAEKSRLSEETYASLGS

SEQ ID NO: 11106 - protein, 346 aa, Streptomyces griseus
MTTVAAYAAPRAKAPLERTTIERRPVGEFDILIDIKFAGICHSDIHQARDGWGEGIFPMVPGHEIAGIVAETGPGVTRFKVGDRVGVGCMVDSCGTCDACLMGREQHCAEGNTQTYNALDRNGEPTYGGYSTHLVVTEKFALSIPEGIALDEAAPLLCAGITTYSPLRRWGAGPGKKVAVVGLGGLGHMAVKIAHALGAEVTVLSQSLRKKDDGLKLGADHYYATGDPRTFEELAGTFDVILSTVSAPLDFGAYLALLRTEGTLVNVGAPEEPVSLNLFSLILGNRSIAGSAIGGIEETQEMLDFCAVHGLGAEIEVIGAGQVNEAYERVLASDVRYRFVIDTATI

SEQ ID NO: 11107 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 11108 - protein, 248 aa, Zea mays
  unsure (1)..(248): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGXVEVYHNLKSVIKKKYGQDATNVGDEGGFAPNIQENKEGXELLKTAIEKRLDTPARL

SEQ ID NO: 11109 - protein, 368 aa, Ipomoea batatas
MAATLSTLTALAGEKSLQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKLMDLACKLLEVLSEAMGLEKEALTKACVDMDQKVVVNFYPKCPQPDLTLGLKRHTDPGTITLLLQDQVGGLQATKDGGKTWITVQPVDGAFVVNLGDHGHFLSNGRFKNADHQAVVNSERSRVSIATFQNPAPEATVYPLTVREGDKPIMEEPITFAEMYRRKMSKDLELARLKKFAKEQQQIVKAAAADKNLETKPIDQILA

SEQ ID NO: 11110 - protein, 488 aa, Asteronema rhodochortonoides
MPENVQERTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPFLGATVKPKLGLSGKNYGRVVYEGLTGGLDFLKDDENINSQPFMRWKERFLYCMEGVNRASAATGEVKGSYLNITAATVEQMYERAEYAYSIGSVIVMIDLVIGYTAIQSMAIWARKAEVILHLHRAGNSTYARQKNHGINFRVICKWMRMCGVDHIHAGTVVGKLEGDPLMVKGFYNSLLLTHLKINLAEGLFFDMDWASLRKCVPVASGGIHCGQMHQLLYYLGDDVVLQFGGGTIGHPDGIQSGATANRVALESMVLARNEGRDYVGEGPEILRHAAATCGPLKAALDLWKDITFDYTSTDTPDFVEIATTSK

SEQ ID NO: 11111 - protein, 506 aa, Pseudomonas aeruginosa UCBPP-PA14
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 11112 - protein, 253 aa, Caulobacter crescentus CB15
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 11113 - protein, 408 aa, Nitrosomonas europaea ATCC 19718
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 11114 - protein, 438 aa, Lactobacillus plantarum WCFS1
MNAANSTFLVLSSILVLFMTPGLAFFYGGLVSKRNVVNTMLSVFMICGLAILLWLAFGYSLSFSGDLGGFVGNLKATWLHGVDLTALTATKIPNGLYLIFQMMFAIITPALFVGAVVGRIRFKFLLTFIIFWSLLIYYPMVHMVWDNGLLAKLGVIDFAGGTVVHINAGITALVLSAFLGARHKYGKDMTQHYNILWVLLGTAILWIGWYGFNAGSALAMNDIAIQAFLTTTVATATSMMTWMVVDMLTKGKPTLVGVCTGTLCGLVAITPACGYVTISGAFWIGLIATLTSYGFITFIKPRLGIDDALDAFGCHGVSGMVGSIMTGLFASKAVNRTISLNGLFYGGGFKLFGLQLLATIFTIGFTTIVCIVIIVLLKRVIRMRVDEREEELGLDQGEHGEVADYTVQMSHDLTNIQHHSDEFRGQLAQLLDKQQRFR

SEQ ID NO: 11115 - protein, 131 aa, Oryza sativa
MAPTVMASSATSVAPFQGLKSTAGLPVSRRSTNSGFGNVSNGGRIKCMQVWPIEGIKKFETLSYLPPLTVEDLLKSRVYLLRPKWPPWLENHKGGPFYREIAHGSPYSTSASYCTRMTMLVLGHTELTLAV

SEQ ID NO: 11116 - protein, 195 aa, Bacillus anthracis str. A2012
MIVLIDNYDSFTYNLYQLLGEYEEEIVVVRNDQITIEQLEEMNPKGIVLSPGPGKPEEAGICIEVIRHFYKNVPILGICLGHQAIISAFGGEIVRAERIKHGKTSRAKHNGTSIFSYVTQPLTAMRYHSLVAAQTSLPQCFDILATAMDDGEIMAVRHNYYPLFGLQFHPESIATEEGGKLIRAFLGEVKEEERV

SEQ ID NO: 11117 - protein, 354 aa, Schizosaccharomyces pombe
MTIFNGLSESGESKKLNSKIEKQIENASKKDKKIYKVLLLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERMRLVESISLFDSIINSQWFMHSSIILFLNKFDLFRKKLEMVPFQDYFPQYEGKNSVKSITRYILWLFVNPSINRAKHNIYPNITTAVDTSNIKVVFSAVKETILQHSLKEAGMF

SEQ ID NO: 11118 - protein, 406 aa, Zea mays
  unsure (1)..(406): unsure at all Xaa locations
MASNGCNGNGNGNGNGKAAPAGVVVPEIKFTKLFINGEFVDAASGKTFDTRDPXYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 11119 - protein, 248 aa, Zea mays
WDPLSAGGAGVGSPGQVVGDSFRFNLEEVECATQYFSDVNLLGKSGFAAATYKGILRDGSVVAVKSLSKTSCKQEESDFLRGLKMLTLLQHDNLVSLRGFCCSRGRGECFLVYDFMVNGCLSRYLDVKDGSSGATVLDWPTRVSIIRGIAKGIEYLHSKKGSKPPVVHQNISADKILLDHHLAPRLSVPGLHKLLADDVVFSALKASAAMGYLAPEYAATGRFTDKSDVFAFGVVVLQVLTGRRDVSQ

SEQ ID NO: 11120 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 11121 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQSALEGMLDTL

SEQ ID NO: 11122 - protein, 217 aa, Metarhizium anisopliae
SAPSADAPMYVMGVNEKTYDGKADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARIEKGASYDEIKEAIKEAANGPLKGILAYTEDDVVSSDMNGNTNSSIFDAKAGISLNKNFVKLVSWYDNEWGYSRRVLDLLAYIAKVDAGK

SEQ ID NO: 11123 - protein, 756 aa, Abies magnifica
MWKLKIAEGGSPWLQTLNNHVGRQVWEFDPKAGTSEDHLAVEKARVDFYNKRFIQHHSADLLMRLQCGGENPLSPLPAQVKLESANDITEEVIQTTLVRAIRFYATIQAHDGHWPGDYGGPMFLMPGLVIALYVTGALNAVLSEMHKKEICRYLYNHQNEDGGWGLHIEGHSTMFGTVLNYVTLRLLGQAPDGGQGAMEKGCAWILDHGGATAIPSWGKMWLSVLGVFDWTGNNPLPPEMWLLPYFLPTHPGRMWCHCRMVYLPMSYIYGRRFVGPLTGIVMSLREELYTVPYEKIDWNQARSMCAKEDLYYPHPFLQDILWGTLHKVVEPALMHWPGSMLRERALQSVMKHIHYEDENTRYICIGPVNKVLNMLCCWVEDSNSEAFKRHLARVVDYLWVAEDGMKMQGYNGSQLWDTAFATQALISTNLLDDCGPLLKKAHIYIERSQVQEDCPGDLNFWYRHISNGAWPFSTRDHGWPISDCSSEGLKAALALSQLPQDIVGKPIPSQRIFDCVNLMLSMQNSDGGFATYELTRSYPWLEKINPAETFGDIVIDYSYVECTSAITQALVSFKKLYPEHRHKEIETCILKATRYIENIQRPDGSWYGSWGVCFTYGTWFGVLGLAAAGKTYQNCSNIRKACEFLLSKQLPSGGWGESYLSCQEKVYTHLEGGRSHIVSTAWAMLALIYAGQALRDPKPLHRAAIVLVNYQMENGDFPQQEIMGVFNRNCMISYSAYRNIFPIWALGEYCRHVLQS

SEQ ID NO: 11124 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQQFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 11125 - protein, 569 aa, Arabidopsis thaliana
MDSARSWFHKFQPRDKPRKKDMFSGSTYGGGVTETTVPDGGNDTETATKLPPLGGDGEALSNSTKQKVAAAKQYIENHYKEQMKNLNERKERRTTLEKKLADADVCEEDQTNLMKFLEKKETEYMRLQRHKMGADDFELLTMIGKGAFGEVRVVREINTGHVFAMKKLKKSEMLRRGQVEHVRAERNLLAEVDSNCIVKLYCSFQDNEYLYLIMEYLPGGDMMTLLMRKDTLSEDEAKFYIAESVLAIESIHNRNYIHRDIKPDNLLLDRYGHLRLSDFGLCKPLDCSVIDGEDFTVGNAGSGGGSESVSTTPKRSQQEQLEHWQKNRRMLAYSTVGTPDYIAPEVLLKKGYGMECDWWSLGAIMYEMLVGYPPFYADDPMSTCRKIVNWKTHLKFPEESRLSRGARDLIGKLLCSVNQRLGSTGASQIKAHPWFEGVQWEKIYQMEAAFIPEVNDDLDTQNFEKFDEEDNQTQAPSRTGPWRKMLSSKDINFVGYTYKNFEIVNDYQVPGIAELKKKESKSKRPSVKSLFESESDSSSSGSEQQTINRSYSNPTPRGMEPNLRRLDSE

SEQ ID NO: 11126 - protein, 502 aa, Zea mays; identical to SEQ ID NO: 7962

SEQ ID NO: 11127 - protein, 482 aa, Rhodococcus rhodochrous
MSMQYDSLFIGGDWIAPSSSKRITAISASTEQPIGSVPEAQEADVDAAVAAARRALDDPAGWAHWAPAARAAAIERLADVLERRAEDVVQCVSAQNGMPVAVARQLEGVFPVVLLRYYAGLARDTATEETRPGLFGGSTLVCREPLGVVGAIVPWNFPQTLAAFKYAPALAAGCTLVIKPSPETVLDAFVFAEAVAEAGIPAGVVNVVPGGREVGAYLVEHPGVDKISFTGSTAAGRSIGEVCGRLLRPVTLELGGKSAAIVLDDAGLDLQTMSEKLFAATLLNNGQTCFLGTRVLAPRSRYSEIVDLFTDLAGTLKVGDALDDTTQIGPMATAAQRDRVEQYIAKGLGDGARITIGGGRPADQDKGWFVEPTIFADVENNHTIAQEEIFGPVLSVIPYSDEDEAVRIANDSDFGLGGTVWTNDPDRGLALAKRVQTGTIGINGYLPEPTAPFGGVKASGLGRELGPEALSNYQQLKSIYLD

SEQ ID NO: 11128 - protein, 253 aa, Triticum aestivum
  unsure (1)..(253): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQXVSFIAFKPPGCEEVRQGPKQAHSRTGHILKVPLQLSTLTIAFGVFLSPFIFLNLGLMGPLFHPNIGEASYFMLGGFVYSPDIIIQYTLGKKKKKN

SEQ ID NO: 11129 - protein, 178 aa, Glycine max
  unsure (1)..(178): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPXYYDGRYWTMWKLPMCGYTDAAQILNKLQYANTTYPNSFIRIIIFHNIPQIQCISLITYKHPSF

SEQ ID NO: 11130 - protein, 505 aa, Populus kitakamiensis
MDLLLLEKTLLGSFVAVLVAILVSKLRGKRFKLPPGPLPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKILVNAWWLANNPAHWKNPEEFRPERFLEEGAKVEANGNDFRYLPFGVGRRSCPGIILALPILGITLGRLVQNFELLPPPGQSKIDTSEKGGQFSLHILKHSTIVAKPRSF

SEQ ID NO: 11131 - protein, 314 aa, Bradyrhizobium japonicum
TMFDGSSIAGWKAINESDMCLMPDPVTETIDPFFAETTMVIACDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCVHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFP

SEQ ID NO: 11132 - protein, 466 aa, Escherichia coli O157:H7
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 11133 - protein, 296 aa, Magnetococcus sp. MC-1
MILPPSFVGALLKYDSVMGVLNAEVSATEKGVSVDGKEITVFEERDPAKLPWGELGVDYVVESTGLFRKRETAGAHLKGGAKRVIISAPAGGDIPTFVMGVNENDYNPATDDIVSNASCTTNCLAPMAKVIDDKFGIERGLMTTVHAYTNDQALLDQPHSDLRRARAAALSMIPTKTGAAAAIGLVMPNMKGRFDGLAVRVPTPNVSLVDAVMEVRAETTAEEVNAALKAATTRFLGYFDAPLVSIDMQGDPRSSIVDGGCTRVNGKQIKVMSWYDNEWGYSNRVLDLILHMASKA

SEQ ID NO: 11134 - protein, 523 aa, Arabidopsis thaliana
MDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDGTVI

SEQ ID NO: 11135 - protein, 473 aa, Bacillus anthracis str. A2012
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 11136 - protein, 525 aa, Zea mays
MSPEAGPIMRPADQLLLPFLLLAVASVAAAGGSWENGYGSILRLPSSSPRRFPRSAAVDLIHALNLHPADASPPLSTAGVEGALAPAGTLVERPIRIASFANGGAATSVEDLGHHAGYYRLPNTHDARMFYFFFESRGHKDDPVVIWLTGGPGCSSELALFYENGPFNIADNLSLVWNDFGWDKASNLIYVDQPTGTGFSYSSDSRDTRHNEATISNDLYDFLQAFFAEHPKYAKNDFFITGESYAGHYIPAFASRVHQGNKNNEGIHINLKGFAIGNGLTDPAIQYKAYPDYALDMGLITKTQFNRINKIVPTCEFAVKLCGTSGTVSCLAAYFVCNTIFSAIRTIIGNKNYYDIRKPCIGSLCYDFSNLEKFLNLKSVRESLGVGDIEFVSCSPTVYEAMLLDWMRNLEVGIPELLESDIKVLIYAGEYDLICNWLGNSRWVNSMEWSGKEAFVSSSEKPFTVDGKEAGVLKSHGPLSFLKVHDAGHMVPMDQPKAALEMLKRWTSGNLSEPSSSSQRLDFTM

SEQ ID NO: 11137 - protein, 156 aa, Prochlorococcus marinus subsp. pastoris str. CCMP1378
MGTWLKHDVITIVNAPLDNVWNTWSDLDSMSLWMSWIESVKTIDQETSTLPDLTEWTLAANGFKFKWKAQITERIEKNKLKWKSIGGLPTQGSVIFESKGDQLTSVHLAVTYELPRMIARFMEEKILGKMVTNELQANIDRFRDLVEKNYKNELTN

SEQ ID NO: 11138 - protein, 229 aa, Triticum aestivum
  unsure (1)..(229): unsure at all Xaa locations
PRVRPRVRPRVRPRVRFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMPSGEAVKYKSSLDAFQQILAKEGAKSLFKGAGANILRAIAGXGVLSGYDQLQILFFGKKYGSAGA

SEQ ID NO: 11139 - protein, 589 aa, Oryza sativa
  unsure (1)..(589): unsure at all Xaa locations
MASPRPHLTAPGTVATLPTPPRAALPSSYLRFVSSTTAALRHDATNTTVGGTPFLRDNHLADAMEEDQSATYSVDDALLSSGFGRYQILILSYAGVGLIAEAMEMMLLSFVGPSVQLEWKLTSHQESMITSIVFVGMLIGAYTWGVVSDNYGRRQLSNGSQKMVCELVSMHSLFQLIVLAIVIKTGPDRRRGFLFTAIVTSGAGFLSAFAPNYVSLISLRFLVGIGLGGGPVLASWFLEFVPAPTRGTWMVVFSAFWTVGTIFEASLAWTVMPKFGWRWLLALSAVPSFVLLLFYVITPESPRFLCMKGRVTEAMDVLEKMARLNNVQLPSGRLVSDKNIELDELSTSESTTLLADAEEDDTIIEDKVSSFGGLSVAKLLSPKLIRPALLLSAPGFGNAFSXYYGIVLLTSELSNGNRICAKEEVESIHSNDASLYKNVFISSFAEIPGSFLSAMIVDRIGRKLSMASMLFTSCVFLFPLIFSRTDILTRVSLFGARLCISASFTIVYIYAPEIYPTSVRTTGIGVASSVGRIGGILCPLVAVALVHSCQQTTAILLFELVIFLSGLAVSFFPFETKGCRLNDTEVVMN

SEQ ID NO: 11140 - protein, 129 aa, Nostoc punctiforme
MLMDLILEDLAAIDDKLSQRHIDLDPGGYFIIYLDRDAGLIYAKHFTNVIDERGLAIDPETGKVIPARKKVERTYTTVFSARTAKELCVKIFEETQPPPVTQLNHAAYLGREFVRAEVALVKGQEYVQD

SEQ ID NO: 11141 - protein, 158 aa, Escherichia coli CFT073
MKLISNDLRDGDKLPHRHVFNGMGYDGDNISPHLAWDDVPVGTKSFVVTCYDPDAPTGSGWWHWVVVNLPADTRVLPQGFGSGLVAMPDGVLQTRTDFGKTGYDGAAPPKGETHRYIFTVHALDVERIDVDEGASGAMVGFNVHFHSLASASITAMFS

SEQ ID NO: 11142 - protein, 242 aa, Brassica oleracea var. botrytis
MGRGRVQLKRIENKINRQVTFSKRRSGLLKKAHEISVLCDAEVALVVFSSKGKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGTSSLIEPNSLLPAWMLRPTTK

SEQ ID NO: 11143 - protein, 109 aa, Klebsiella pneumoniae
MSQTSFNKAQFQAALTRQWQHFGLQSASEMTQRQWWRAVSGALSELLSAQPVAKATEGERHVNYISMEFLIGRLTGNNLLNLGWYQQVSDELQAHDVNLTDLLEEEIDP

SEQ ID NO: 11144 - protein, 333 aa, Saccharomyces bayanus
MSEHEDKKQKVGGSSLDQLKNAGTHVVADSGDFESISKYEPQDSTTNPSLILAASKLEKYEKLIDAAVEFGRKHGKTDHEKVENAMDKILVEFGSQILKIVPGRVSTEVDARLSFDKKATVKKALHIIKLYKDMGVPKERVLIKIASTWEGIQAAKELEAKHGIHCNMTLLFSFTQAVACAEANVTLISPFVGRIMDFYKERSGEDYTGETDPGVLSVRKIYSYYKRHGYKTEVMAASFRNLDELKALAGIDDMTLPLNLLQQLHESTDPIENKLNAETAKQEGVEKVSFINDEPHFRYVFNEDQMATEKLSDGIRKFSVDIEALYELVEKKM

SEQ ID NO: 11145 - protein, 444 aa, Haemophilus influenzae Rd
MTNNNKTMEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 11146 - protein, 603 aa, Eremothecium gossypii
MRISQKLKQRAGAADEEQPKASFSFEFFVPKTLQGVQNLYDRMDRMYQTQPEFIDITWNAGGRLSQRTSELVATSQGVLGLETCMHLTCTNMSTALVDEALERAYEAGCENILALRGDPPLQGTWEPCAGGFRYAKDLVAHIRARYGDHFDVGVAGYPEGHEEASGAELIGYLKEKVDAGADFIITQMFYDADLFLKWCDAVRAAGISVPIIPGIMPITSYAALLRRAKWCQVRLPPEFLERLEPVKDDDQAVREIGTVLVADMCRKILASGHVTHLHLYTMNLERASLMILERLQLIDTGGAGVRRRPSTNETLTWRKSLNPTRRKEGVRPIFWQRRPYSYVARTSQWSADEFPNGRFGDSSSPAYGDLDLCGHTVLRQTYQRSLELWSTPRTLLDLAALVISYLKGDLKCLPWSDVPLHQEADALLDSLIRLNEHLVLTINSQPKVNGAPSADPIVGWGPANGYVYQKQYLEFLLPKHHLPAFHAALTADFPTLTYFAVDADDNLASNHPDDTQANAVTWGIFPGREVLQPTIVEKASFLAWKDEFYRILDDWRLSFDENGAADSAALLAHLTSDYALVNIVDNDFVATADNIYCLLARFF

SEQ ID NO: 11147 - protein, 194 aa, Actinobacillus pleuropneumoniae serovar 1 str. 4074
MLSKETLKIGLVSVSDRASGGVYQDQGIPELQAWLESVLTAPFEVETRLIPDEQAIIEQTLIELVDTHHCHLVLTTGGTGPAKRDVTPDATLAVAHREMPGFGEQMRQVSLHFVPTAILSRQVGVIRHDSLILNLPGQPKAIKETLEGVKDAQGNTLVRGVFSAVPYCLQLLSEIYIDTHPEICESFRPKSARR

SEQ ID NO: 11148 - protein, 353 aa, Triticum aestivum
MEHSEQEQHAMDLPPGFRFHPTDEELITHYLAKKVADARFAALAVSVADLNKCEPWDLPSLARMGEKEWYFFCLKDRKYPTGLRTNRATESGYWKATGKDKDIFRGKALVGMKKTLVFYTGRAPKGDKSGWVMHEYRLNAKLHAASTSRGSLSGGRAASSRNEWVLCRVFKKSLVGGVVSSAPASSAAKKSGVEMIEEIGSSVAAVTPLPALLDMSGSGASFDPAAHVTCFSNNALEAGQFFNPTVTGGCATDTDNHGLASSYSPLASFTQYGGQLHHGVSLSLVQLLESSGYHRGLADDMAPCGNQQQPAACKGERERLSASQDTGLTSDVNPEISSSFGQKFDHEPAPWGY

SEQ ID NO: 11149 - protein, 488 aa, Dictyosiphon foeniculaceus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAATCGPLKAALDLWKDITFDYTSTDTPDFVEVATESR

SEQ ID NO: 11150 - protein, 409 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 11151 - protein, 219 aa, Zea mays
MPGEMNPVPQFTTGTVEQKLAATPESRLPIAITCRGTSTPAATMSSGKRSFFAPKKKATNPFDSDSDDDKPQQRPARASSVPPPDEQRGSSSLFGAGDRGGLFSSAANHHYRNDFRDAGGLEGQSVQELEGYAAYKAEETTRRTRGCVRIAEEMRDTASKTLVTVHQQGQQIHRTHMMAVDIDQDLSRSEKLLGDLGGLFSKKWKPKKNGAIRGPMLTR

SEQ ID NO: 11152 - protein, 68 aa, Oryza sativa
  unsure (1)..(68): unsure at all Xaa locations
SSCSPNQPTPSTDGTHGRDAAVVLEATMICIDNSERMRNGDYSPLXFQAQADAVNLICGAETYSNPEN

SEQ ID NO: 11153 - protein, 172 aa, Streptococcus pyogenes M1 GAS
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELEGLNGRHAIRNYDYKVLMQFPG

SEQ ID NO: 11154 - protein, 543 aa, Candida tropicalis
MSSSPSIAQEFLATITPYVEYCQENYTKWYYFIPLVILSLNLISMLHTKYLERKFKAKPLAVYVQDYTFCLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 11155 - protein, 350 aa, Streptomyces sp. TP-A0274
MLAGGSGSRLRPITHTSAKQLVPVANKPVLFYGLESIAEAGIREVGIVVGDTAAEIEAAVGDGSRFGLDVTYLPQEAPLGLAHAVTIARDYLGDDDFVMYLGDNFIVGGIGALLDRFRVSRPDAQILLTRVSDPRAFGVVELDTDGRVIGLEEKPEHPRSDLALVGVYMFSARVHDAVSRLKPSWRGELEITDAIQELIDADCRVESTLVSGYWKDTGNVADMLEVNRLVLDGVEADCSGVVDSSELVGRVVIEEGATVTGSRIVGPVVVAAGSRIHDSYIGPFTSIDRGCSVIDSEVEYSIVLRGASIVGVRRVERSLIGREVEVTSTPRILRSHRLVLGDHSKVQVAS

SEQ ID NO: 11156 - protein, 224 aa, Zea mays
MASSMLSSAAVVTSPAQATMVAPFTGLKSSAAFPVTRKANNDITSIASNGGRVSCMKVWPPVGKKKFETLSYLPDLTEVELGKEVDYFLRNKWIPCVEFELYHGFGYREHGSTPEYYDGSYWTMWKSPPCWKDWTLLRGLKGSPKMGKTENPNRFSYGKNSGFEKTTPQGSGGSFFFPPKKTTPNFPRGGFIFFCKKPPSKKKTPRRVFFLLSTGAGGVFFSHR

SEQ ID NO: 11157 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVNARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 11158 - protein, 495 aa, Rhodobacter sphaeroides
MLQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 11159 - protein, 506 aa, Yersinia pseudotuberculosis
MRYAHPGTPEALVSFKAIYGNYIGGEFIEPLGGQYFMNTSPVNGSDIAQFPRSDARDIDAALDAAHQAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDIFPAGVINVVQGYGREAGEALARSKRIAKIAFTGSTPVGRHIMACAAENIIPCTVELGGKSPNIYFADVMEAEPEFIDKAVEGLVLGFFNQGEVCTCPSRALIHESIYAPFMARVMTKVANIRRGDPLDTETMIGAQASRQQFDKILSYIDIARKEGGEILTGGARATITPALDSGFYIQPTLIKGDNLMRCFQEEIFGPVIGVTTFKDEAEALAIANQTQFGLGAGIWTRDAHLAYRMGRGIKAGRVWTNCYHVYPAHAAFGGYKQSGVGRETHKMALNQYQQTKNLLVSYDTAPLGLF

SEQ ID NO: 11160 - protein, 358 aa, Zea mays
EGEKPDSIISTNLNFNGKLQPDASNGTAQVFINGREITKIELRILKIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHDAYPQQPVNKYSLSSPLCSTVEFFLS

SEQ ID NO: 11161 - protein, 508 aa, Bifidobacterium longum NCC2705
MADTNVNGGTQQATGKLKSVESLDQANEMERGLSNRHVQFIAIGGTIGTGLFLGSGKSISLTGPSIIFVYILVGIIMFFLMRAIGEMMYRDPSQHTFINFITRYLGNGWGHFAGWTYWAALVLLGMTEITAVSTYFITFFDTFGIDLTHWKWLIELCFLVVLVSINLIAVKVFGEVEFWFSMIKITLICAMIATAVVMIVIGYHYPAVQIHGVDHVSPAGHAGFDNLFANFSFAPNGWMAFLMSFQMVFFAYEMIEFVGVTVSETKNPRKVLPKAINEIIVRVLIFYVGALMAIMCIVPWTSFKPNKDGSFASPFIMVFQYAGLNWASALVFFVVITAASSALNSLLYSAGRHLYQLAGESPNPTLNKIGQVSDRKVPARAILVSAVLILLSPIVNAIPGVSGAFVLFSSASSAVFLFIYILTLMAHRKYRRSADFIPDGFVMPAWKVLNTVAIAFFVFIYLTLFLADDTRNSAIAGLVWLVGFGGFSMLRERYRSRDLKVALEHKEI

SEQ ID NO: 11162 - protein, 118 aa, Glycine max
  unsure (1)..(118): unsure at all Xaa locations
KLVNYYVKEKYTLRYTGGMVPDVNQIIVKEKGIFTNVTSPTAKAKLRLLFEVAPLGFLIEKAGGHXSSDGKQSVLDKVISQLDERTQVAYGSKNEIIRFEETLYGSSRLAASATVGAT

SEQ ID NO: 11163 - protein, 759 aa, Costus speciosus
MWRLKVAEGSGPWLRSTNNHVGREVWEFDPSGGTPEEIAEVERARETFRDHWVEHTNSADLIMRLQFEKENPAEMKYSVIRIQEAENISKEAVDICLRKAVTRISTLQAHDGHWPGDCGAGPMFLLPGLVISLHITGALNTILTPEHQKEMRRYLYNHQNVDGGWGLYSNGPSNMIGSVLHYVTLRLLGEGANDGEGAMEKGRKWILDHGSATATSSWGKLWLSVLGVYEWAGNNPMPPEFWLLPYCVPLHPGKMWCLSRTVYLPMSYLYGKRFVGAITPIVVSLRKELYNVPYDHIDWNKARTDCAKEDQYYPHPLIQDIIWGSLHNFVEPILMRWPGSKLREKALSTVMQHIHYEDENTRYICVGPVNKALNMLCCWIDDPNSEAFKLHLPRVYDYLWLAEDGMKMKAYDGFQLWEAAFAVQAIVSTNLSEEFGPTLKKAHEFVKNSQILEDCPGDLNYWYRHISKGAWTFSTADEGWPVSDCTGEGLEAVLLLSMISPKIVGDPLDERRLYDAVNLLLSLMNKNGGFATYELTRSYAWLEIMNPADVFINIVVDHQYVECTSSAIQPLALFKKLYPGHRQEEIDNCIMKAARFIERTQRADGSWYGSWGVCFTYATWFGVKGLVAAGRTYENSCYIQKACNFLLSKQEASGGWGESFLSCRKKVYINLEGNKTHAVNTSWAMLALIAAGQGERDPKPLHRAAKALINMQMENGDFPQQEMMGNFMGGSSLNYPLYRNIFPTWALGEYRNHIFHSMT

SEQ ID NO: 11164 - protein, 385 aa, Mycobacterium tuberculosis H37Rv
MEVSRALLFELGVLLAVLAVLGAVARRFALSPIPVYLLAGLSLGNGGILGVAAAGEFIATGAPIGVVLLLLALGLEFSATEFASSLRHHLPSAGVDIVLNATPGAVAGWLLGLDGVAILGLAGVTYISSSGVIARLLEDLRRLGNRETPAVLSVLVLEDFAMAAYLPLFAVLATDGSWLEAVVGMTVAIAALLGAFAASYRWGHHVGRLVTHPDSEQLLLRVLGITLIVAAVAESLHASAAVGAFLVGLTLTGETADRARMVLTPLRDLFATIFFLGIGLSVDPGKLVSMLPVALALAAVTAATKVATGMFAARREGVARRGQLRAGTALVARGEFSLIIIGLAGASIPGVAALATAYVFVMAIVGPILARYTGGGLPAAAVASN

SEQ ID NO: 11165 - protein, 312 aa, Oryza sativa
KGVDVVAINDPFIDVTYMVYMFKYDSTHGRFKGDAHEEGGMLVVNGKKIQVFQESDPSNIPWAKAGAEYVVESTGVFTTLEKAEAHRKAGAKKVIISAPSPDAPMFVMGVNHEKYEPGMNIVSNASCTTNCLAPLAKVIHDNFTIVEGLMTTVHAATATQKTVDGPSKKDWRGGRGAAQNIIPSSTGAAKAVGKVIPELNGKLTGMAFRVPTPDVSVVDLTVRLGKDATYDQIKAAVKAAANSDQWKGVLGYTEDEVVSTDFLGDTHSSIFDAKAGISLSPTFVKLVAWYDNEYGYSNRVVALIKYMKTKDN

SEQ ID NO: 11166 - protein, 73 aa, Salmonella enterica
SEQALYYIGGVIKHAKAINALANPTTNSYKRLVPGYEAPVMLAYSARNRSASIRIPVVASPKARRIEVRFPDP

SEQ ID NO: 11167 - protein, 91 aa, Oryza sativa
ENEKSGFISLVSRYLSGEAEQIEWSKIQTPTDEVVVPYDTLSAAPEDLNETKKLLDKLVVLKLNGGLGTTMGCTGPNGVLNVNDMEGLNIV

SEQ ID NO: 11168 - protein, 324 aa, Haloferax volcanii
MTEEIVVIPGDGIGAEVIPAAVDVLKAVGDFEFVEADAGDHVKEETGEALPQETYDLAAEADATLFGAAGETAADVILPLRTAVDSFVNVRPAKAYPGVDALRPETDLVFLRENTEGVYSGHEDRLSEDLSTLTRVVTTSASERLAEYACDYVGGEGGSFQVAHKANVMRETDGRFRDAAVAVADERGVETEEVLMDAFATRVCLDPTQFDTIVCPNLAGDVLSDLAAGLVGGLGLLPSANIGPDAALFEPVHGSAPDIAGEGIANPAATILSAAMLLDYLDHEAEADRVRSAVEGVLADGPRTPDLGGDASTEDVTAAILDRL

SEQ ID NO: 11169 - protein, 334 aa, GIBBERELLA ZEAE PH-1
MQSILQKATGIGPQVIKPENLQGRVAIVTGGALGIGYEVSRALAHAGCKVIMVNRKEEQGTSAIEAVKNEKHDADIDWKECDMGNLSQIREVFGGFRESLDRLDFLVLSAGINTNQFGLDSDGIERHFGVNFLGHFYVCNQLWPLLRKTSKMENVSPPRVVFEASEMHRLAQLSNVQFKTKEEINDPDLDPTARYNRTKLAMILFAKYGLAGKVIAENKDKIYALSVHPGAVNTAMQQQWKDAYPGLTGKLLSWTMQAIGRDVEQGSYSALWALTSSRIEEENLNGYYFVDPDKEGEETSQASNPELASNLWDLSTSFIKEKLGEDALADWNGS

SEQ ID NO: 11170 - protein, 330 aa, Agrobacterium tumefaciens str. C58 (Cereon)
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSSLKALGEKHGLI

SEQ ID NO: 11171 - protein, 192 aa, Glycine max
  unsure (1)..(192): unsure at all Xaa locations
MILEEGCAKMQFFQPSKEREDENAKIEEAGVDLKVMIEEMESIDVPSVFICPISLEPMQDPVTLCTGQTYDRSNILKWFSLGHKTCPTTMQELWDDVVTPNSTLSHLMFTWFSQKYLAMKKKLKDVQGRALEILNMLKKVKGQAXVRALQDLRQLXASHVNARKALEENGGVALVFNFLGPFTSHAVGSEAI

SEQ ID NO: 11172 - protein, 477 aa, Gracilaria gracilis
KNERYESGVIPYAKMGYWDPDYVVKDTDVLALFRVTPQPGVDPVEASAAVAGESSTATWTVVWTDLLTACDLYRAKAYKVDAVPNAPDQYFAFISYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAASGEVKGHYMNVTAATMEDMYERAEFAKQLGSVIIMIDLVIGYTAIQTMAIWARKNDMILHLHRAGNSTYSRQKSHGMNFRVICKWMRMSGVDHIHAGTVVGKLEGDPLMIRGFYNTLLQTHLKVNLPQGIFFEQDWASLRKVTPVASGGIHCGQMHQLLDYLGNDVVLQFGGGTIGHPDGIQAGATANRVALESMVLARNESRDYVAEGPQILRDAAKTCGPLQTALDLWKDITFNYTSTDTADFVETPTANV

SEQ ID NO: 11173 - protein, 479 aa, Eremothecium gossypii
MGKRVVLIDNYDSFTWNLYEYLCRSGAAVEVHRNDKISVAEVAELEPDVVVISPGPGHPARDAGISQECIRHFAGRVPVVGVCMGQQCIYEAFGGRVESAGEIVHGKTSELRHDGRGLFQGVPQAVAVTRYHSLAGLASTLPAELEVTARTETGVVMGVRHRKYTVEGVQFHPESILTDHGQLMVRNMLALEGGTWAENDKLQLRAGAGSVLSEIYAQRQEDVAAQMAMPGTGMADLEASFRLGVLPGVVDFHERLARDAPRLAVVAEIKRASPSRGNISEALAAEQALAYAEAGVSAISVLTEPHWFKGNLQDLTSARRALERHYTAETRPALLRKDFLFSRYQILEARLAGADSVLLIVKMLTQPQLEDLYLYATQEMGLEPLVEVSNREELDRALMLKPRVIGVNNRDLNSFSVDLDTTSSLVHHVPAGTLLLALSGISGPQDAARYREEGVQGLLVGEALMRADNVGEFVQRLVQ

SEQ ID NO: 11174 - protein, 485 aa, Ginkgo biloba
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 11175 - protein, 302 aa, Spirochaeta stenostrepta
RIGRTVLRAALGNPGIEIVAVNDLTDASVLAHLLAHDSIYGALPAKVEAVNGAILVNGKRIAVYAEREPGNIPWAKEGVDLVVESTGRFTERAKAEAHITSGGAKRVIISAPAKGDDLTIVMGVNEGRYDPALHHVVSNGSCTTNALAPLARVLHDTFRIEHGQMMTTHAYTNSQALHDQPEKDLRGARAAAVSIIPYSTGAAKAIGKVIPELDGLLAGFSLRVPVPVVSIVDLTVRVGRDTTAAEVNAAFRAASEAGPLRGILGYSEEPLVSADYRGDDRSSILDALSTLVTGGRMVKVLS

SEQ ID NO: 11176 - protein, 458 aa, Zea mays
  unsure (1)..(458): unsure at all Xaa locations
MMPTFLFWWCRVMLVGWGGNNGSTLTAGVIANREGISWATKDKVQQANYYGSLTQASTIRVGSYNGEEIYAPFKSLLPIVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEVSPSTLYAIACVMEGXPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 11177 - protein, 304 aa, Prochlorococcus marinus subsp. marinus str. CCMP1375
MHDFLPYAWFKGKCVPFDEAKISIATHALHYGTAAFGGMRAIPDPSDNGNFLLFRADKHAKRLSQSAKLLLTELSERYILQSIETWLKANKPSKPIYIRPFVYTSDLGIAPRLHNIETDFFIYGLELGDYLSPEGVSCRISSWKRQEDCSLPLRGKISGAYITSSLAKTEAVLTGFDEALLLNSQGKVSEASGMNLFIVRDGNLITPGTDQDILEGITRASVIEIANYLGINVIERPVDKTELFIADEVFLTGTAAKITPIKQIESTLLNTELPIMNKLRDYLISITENKEDKFSNWITSIKIS

SEQ ID NO: 11178 - protein, 358 aa, Neurospora crassa
MAEFIRAQIFGTTFEITSRYSDLQPVGMGAFGLVCSAKDQLTNQNVAIKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMMYSEILDYHNVEASGQMMFQEDVPPQ

SEQ ID NO: 11179 - protein, 370 aa, ASPERGILLUS NIDULANS FGSC A4
MSEKSYNILVLPGDGIGPEVMAEATKILSLFNTSTVRFRTQTELIGGCSIDTHGKSVTQAVLDAAVSSDAVLFAAVGGPKWDHIRRGLDGPEGGLLQVRKAMDIYANLRPCSVDSPSREIARDFSPFRQDVIEGVDFVVVRENCGGAYFGKKVEEDDYAMDEWGYSASEIQRITRLSAELALRHDPPWPVISLDKANVLASSRLWRRVVEKTMSEEYPQVKLVHQLADSASLIMATNPRALNGVILADNTFGDMVSDQAGSLVGTLGVLPSASLDGLPKPGEQRKVHGLYEPTHGSAPTIAGKNIANPTAMILCVALMFRYSFNMEAEARQIEAAVRTVLDKGIRTSDLGGSTGTREFGDAVVAALKGEL

SEQ ID NO: 11180 - protein, 448 aa, Triticum aestivum
  unsure (1)..(448): unsure at all Xaa locations
MAAAAVAADSKIDNLRDAVXRLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVXPFSNSNIEMHTFNQSQYPRVVTEDFLTLXAKGRSGKDGWYPPTHGGVAPSLIQKRKLXVLAVTVKGEYVRGELIDLASLADDQVSKLISHEARVILNANNLWPNVYGNKWKSNEKFKKFETIPQWVNVDGVKVLQLETAAGAAIRFFEKAIGINVPRSRFLPVKATSDFLFERYGHXVPCLGTLPATATAGMLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 11181 - protein, 229 aa, Ipomoea batatas
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 11182 - protein, 224 aa, Pseudomonas syringae pv. tomato str. DC3000
MQPFVIAPSILSADFARLGEEVDNVLSSGADFVHFDVMDNHYVPNLTIGPMVCSALRKYGVTAPIDVHLMVSPVDRIIGDFIEAGATYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRAELALSRA

SEQ ID NO: 11183 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDTNEMCAFVRQTIADLSSKEVSEATRIQYGGSVKPNNIKEYMAQTDIDGALVGGA

SEQ ID NO: 11184 - protein, 130 aa, Zea mays
  unsure (1)..(130): unsure at all Xaa locations
SNHAQPVPSYIKPVYRHYTTELRHEGKDGASRWVARPRVAERYMLRTRTAGPNLRVMLXRGGGNIRSTLTDCVIANREGILWATKDKVQQANYYXASPRLSTMRVNRFNGXEEIYAAXFRALLPMENPND

SEQ ID NO: 11185 - protein, 333 aa, Magnetospirillum magnetotacticum
  unsure (1)..(333): unsure at all Xaa locations
MGPLAFHGSRRVNGVSALHSELLKSTVFKDLHAIEPEKIVNKTNGITFRRWLHNANPELTALAVEVAGEGVLDDPEGLRKLEPFADDAEFRTRYAAMRKTRKKRLAQVIAERTGIVVDPAALFDVQIKRIHEYKRQLLNLVETVALYQAIKQAPNKDWTPRVKIFAGKAAPSYVQAKLIIKLAGDIARVVNEDPEIGGKLKVVFLPNYSVSLAEVIIPAADLSEQISTAGMEASGTRHXMKLAXHTARSPSARSMAPTSRSRTMSARTTSSSSASTPRRCWPAPASRITRARPSPPHRGWRRLWTPSATAPSRRRSRAASPRSSTSCATATAT

SEQ ID NO: 11186 - protein, 98 aa, Glycine max
MAISKALIASLLISLLVLQLVQADVENSNKKRGYRKKIDCGSACVARCRLSSRPNLCHRACGTCCARCNCVPPGTYGDYDKCQCYATLTTHGGRRKCP

SEQ ID NO: 11187 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 11188 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 11189 - protein, 220 aa, Oryza sativa (japonica cultivar-group)
MAGTRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFDNISRWLKELRDHADANIRIMLVGNKTDLKHLRAVATDDAHKFAEAEGLSYIETSALEATNVEEAFQLILGDIYRAISKKPVASDEGGAGAAGGVKEGKTINVAAGDANSEKKQCCST

SEQ ID NO: 11190 - protein, 510 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGPSTPVNLSVMFHSITNSIVARATFGKKRKNAAEFMAAIKSGVGLASGFNIPDLFPTLTTVLATITGMKRSLHGIHTSHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASGLRYLKLVIKEALRLHPPAPLLVPRESIDVCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 11191 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARPALQGADVVLISAGVARKPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILPXLSQIPGVSFTEQEVADLTKRIQNAXTEVVEAKAGGGSATLSMGQAAARFGLSLVRALQGEKGVVECAYXEGDGQYAR

SEQ ID NO: 11192 - protein, 236 aa, Chlorobium tepidum TLS
MTTSDNGKVLLITGASTGIGRSTAIQAVEAGWRVVVAARSAEKLAALAAELGAERAMAVPCDVADWNQQEAMVQKTIGRFGRLDAVFANAGFSKGSSFIEGEHRPDEWRDMVMTNVFGAAATARLTLPELMKTKGHFLVTGSVLGRVTSMRNLYAATKWAVTGMAQAIRNEVASLGVRVTLVEPGIVDTPFWEGLQKPAAPELLPEDVARAVLFALGQPPHVDVSEIIIRPTGQAH

SEQ ID NO: 11193 - protein, 153 aa, Glycine max
GLILYKRCRRGLSNHFMGKSKSFTDLSQVNTLNTVKELQKQENPFNKRRRVQIATKLTRKSSFYAWSNPKSMPLLPVHEDEDNFLEEEEKPKKVSPSSSSSYSSEENKQDHVLVPKSYVDHMRARFGSFKSRSLSDLKEHDEEQEQEDDDDDA

SEQ ID NO: 11194 - protein, 350 aa, Caulobacter crescentus CB15
MATLLLLPGDGIGPEVCAQVRRVAAALTPDLKVDEALYGGASYDTHGTPLTDEVREQALASDAVLMGAVGGPKWADAPRHLRPEAGLLNLRKAMDVFANLRPAYCFEALAGASSLKPELVSGLDIMFVRELVGGVYFGQPRGIEDLADGQKKGFDTQVYTTSEIERVGRVAFELARGRTNKVHSAEKSNVMESGLLWKQVITELHAREYPDVQLEHILADNCAMQLVRAPKQFDVIVTDNLFGDILSDAAAMLTGSLGMLPSAALGAPGKPGLYEPIHGSAPDIAGKGLANPLAAILSFEMALRWSLKQTEAADALLAAVKAALDNGARTRDLGGSLTTTQMGDAVLAAL

SEQ ID NO: 11195 - protein, 189 aa, Larix laricina
MASSIMALSSTAAVAAVAAPSKTGNSNVVSAFTGLKSMAQFPSSKTMSNAGAEWEQKTTSNGSRVRCMQVWPPYANKKFETLSYLPRLTPEQLVKEVEYLLKNKWVPCLEFEEDGEIKRVYGNSPGYYDGRYWVMWKLPMFGCTEASQVLNEVNECAKAYPNAFIRVIGFDNVRQVQCISFIVHKPEYN

SEQ ID NO: 11196 - protein, 589 aa, Cicer arietinum
KGKLLFRVISVFLVISLAVLAFEVVAYFQGWHFVNPNLHIPNTSDLEGLFHVAYVAWLTFRAEYIAPPIQALSKFCVVLFLIQSVDRMLLCLGCFWIKFKKVKPRINGDPFKVNDVEGSLCNYPMVLVQIPMCNEREVYEQSISAVCQIDWPRDRLLIQVLDDSNDESIQWLIKAEVSKWNQKGINIIYRHRLVRTGYKAGNLNSAMSCDYVKDYEFVAIFDADFQPNPDFLKKTVPHFKDNPELGLVQARWCFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSRPKQLFRLCLPAILRSKVSPWKKAHLILLFFLLRKLILPFYSFTLFCIILPLTMFVPEAELPLWLICYVPVFMSILNILPAPKSFPFIVPYLLFENTMSVTKFNAMVSGLFQLGSSYEWIITKNAGRSSESDLLAAAERETKSIEQQKIHRGVSDSELVELHQLKEHKEAATEPVKKVNKIYKKELTLAFLLLTASVRSLLSAQGVHFYFLLFQGVTFLLVGLDLIGEQMS

SEQ ID NO: 11197 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 11198 - protein, 300 aa, Oryza sativa
MEMTRSLTLVPLPATLRPASAACRRRRRRRGLPFGALFSPSPPSNQQQEMHIRALQPRQDWVGEWVRSNDTLVRGLPILGGGASLLAVLLNRAVSGIAAVADASSSQSRADILTLALSVTDILAGLVWLSIRPKSISPVVPRGVECKRVGTGVLDSALRELLWTWDSLTTATCCKSLVVVYGGNCVLQIGVAAGSPEDGNAVMVDAQKFMQGSLYRSAMESKKRDHFGLLAESYLANLALYPGRTELPFLPANTQALILQPIGDKGIAVIGGDTIRGFTNLDQAWIAMIADKLDATLSKS

SEQ ID NO: 11199 - protein, 134 aa, Triticum aestivum
MSGRLVRRVLQGREASPQDPAEDALVVVEEEEEEEEAGSPTRVAARNPFDLLDDDDDDEPEEDKEDEVHTDQTASYTEEKQYVKKKPNGAVPETNKKSKKKKKKGKAEPPASTKLRDEKSLDSILEDLAEKRPC

SEQ ID NO: 11200 - protein, 481 aa, Neurospora crassa
MGNNPSTSRDSKTPNPQSSSSSSQSQSQHQSLASIQNDSARAVKRDTKHPIPVPNQRVAAPPEPSLTQAQGTAVQPPSTTARPKSLHSRMPPSQSGSPGSSVPTSSATPTKPVEVRQLRPEDSHEPAKPVAVPTPCHASSCSPRSPVRSPLSERSDAFETAAMQLSSLQDVSYLTRPPRLPLPIEEEVHTPGSPIIAPTDIGVPLEDADTFTALTRRSSNLSNSSTLDEEDTEELRVDKTRPTVPTRLEWLRGGEKVYVTGTIFQWNRKTRLHPVEGRPGVFAAIINILPGTHHVRFLVDGQMQTSPDLPTTVDFGNNLVNYIEVSPDDVGRTAAQAAAASAAKDSQQPTEPKTSASETEESKAPRDRPVPPAELFENKIPQYLLDFDAPEESPPYLSAVNAIEKLPTPPALPGFLGKPILNAATLIKDDNSVLNMPNHTVLNHLATSSIKNNILAVSATTRYKNKYVTTIMYKPTTTEGI

SEQ ID NO: 11201 - protein, 434 aa, Buchnera aphidicola str. APS (Acyrthosiphon pisum) [sequence omitted]

SEQ ID NO: 11202 - protein, 638 aa, Oryza sativa
MSFAVVSLCIAWLTIKKNIKYHLPLLNRWTPPTAAAAERHPPPPPPFAPALEAVGASGCATRGDEGERKGEKLGFRLESSRDSDRQNHPNTSLICTNVPDTRTGPRIRTSPCPPPPHPQQCRIRHSGRNSEGLVLIAEVFQKTTTTVDLPDLSRQQRMMTSTASSRRTPPRKHWICIEDKFRAAGDYVSQKSSSVFGKKKVEPMVKDAAAPGKGGRLKMESSNAQPQDSAYSVPKNPSMTCCRKRTDGATFLEDLKDHIEEFIHASMDEHKTCFKHHPKGGILFQIPLLQVIEKRHQKRNETALEPSSPAWAPHTSHGAATSDPQPLNRPEPSLPLSRPPLHRSSALKTPPRRRRLSSHRHRASAESREEDQIGEAKKPHRREEEERERMYFRPPPKGPEWAGGDAEAGMARPLYPMMLESPQLRWAFVRKVYAILSIQMLLTIAVASVVVFVRPVALFFVSTPAGFALYIFLIILPFIVLCPLYYYYQRHPVNLLLLALFTAAISFAVGLTCAFTKGEVILESAILTAAVVVSLTAYTFWAARRGHDFSFLGPFLFAAVMILMVFALIQVFFPLGRVSLMIYGGLAALVFCGYIVYDTDNLIKRYSYDEYVWAAVALYLDVINLFLSLLTLFRASDS

SEQ ID NO: 11203 - protein, 93 aa, Methylobacterium extorquens
MTDFHRIKRLPPYVFEQVNRIKAAARARGADIIDLGMGNPDLDAPRHVIEKLVETAGKPRTDRYSASKGIAGLRRAQAGYYQRRFGVSLNPDT

SEQ ID NO: 11204 - protein, 513 aa, Schizosaccharomyces pombe
MKHNEVFGWTLKVLSFLLVVIPANALDKHGWRKQSIYSLLTDRFASTNPKPCNPEDREYCGGNWRGIIDKLDYIQGMGFTAIWISPIIKNIEGRTKYGEAYHGYWPQDLYTLNPHFGTEQDLIDLADALHDRGMYLMVDTVVNHMGSSDPRNIDYGIYRPFNQSSHYHPMCPIEQDKPLSLEQCWIGTEDMTLPDIDTENPQIIETLYNFIHDQVKQFKIDGLRVDATKHVRRTFWPGFCESAGVYCQGEEWTGQADLFCEWQEYMDGLHNFPVQGVAAESVIPLNDRALRKTAIAMNLVAHHCKDSTLLGLFLESQDAPRLAALNNDYTVLKNAMTLNLMSDGIPIVFYGQEQMFNGSHDPVNRPALWDQGYNTDGPLYQYTSKVNKIRRDLINSEDGEIYIRSITHAIMIGDHVMVMYKGPVITFITNYGAVDKEYLIKMPGSETMIDLLTCTLIEVEGEVMRTSIKKGEPKILYPYQLAFRDGFCQEQITLQEIDDVFMGRNEINGPDRK

SEQ ID NO: 11205 - protein, 793 aa, Oryza sativa
MAVGTESGSGGVAESAPSTPMSAMTTTPISARSVRWESDMPDIEEGGGGLERPLLRRRGTNTTSQMAIVGANVCPIESLDYELVENEVYKQDWRSRGKLQIFHYQILKWVLALLVGLIVGLIGFFNNIAVENIAGFKLLLTTNLMLQNRYKAAFLWFISCNAMLAAAAAALCAYFGPAAAGSGIPEVKAYLNGVDAPSILAPSTLFVKIVGSIFGVSAGFVLGKEGPMVHTGACVASFLGQGGSRKYGFTWNWLRYFKNDLDRRDLITCGAAAGVTAAFRAPVGGVLFALEEATSWWRSALLWRTFSTTAVAAMVLRSLIEYCRSGNCGLFGKGGLIMFDVSSQVTSYTTMDLAAVVLLAIVGGLLGALFNFLLNRILRVYSYINEKGAPYKIILTVVISLVTSCCSFGLPWLTACTPCPPELAASGHCPTIGRSGNFKNFRCPPGQYNAMASLFLNTNDDAIRNLFSGGTESEFGVPMLLAFFTAVYSLGLVTYGVAVPSGLFIPVILSGASFGRLLGKLLGVLTGLDTGLFALLGAASFLGGTMRMTVSVCVILLELTNDLLLLPLIMLVLLVSKTVADCFNKGVYEQMVRMKGLPYLEAHAEPCMRSLVAGDVVSAPLIAFSSVESVGTVVDTLRRTGHNGFPVIEDAPFAPEPELCGLVLRSHLLVLLRAKTFTADRVKTGAAEVFRKLAPFDFAKPGSGKGLTVDDLDLTEEEMAMYVDLHPIANRSPYTVVENMSLAKAAVLFRQLGLRHMCVVPRTPGRPPVVGILTRHDFMPGYIRGLFPNVLRE

SEQ ID NO: 11206 - protein, 310 aa, Streptomyces coelicolor A3(2)
MTGWSTGDIPDLDGRVAVVTGANGGLGYVIARELARKGATVVLACRSEERGSAAVRRLMGEVPAAAVEPARLDLGDLASVREFAYGLPYERVDLLVNNAGVMALPHGTTVDGFETQFGVNHLGHFALTGLLLPSLLAAPGARIVTVSSVLHALARVDPRDLNSVRRYGRWTAYARSKSANLLFTHELARRLAGREGASDVRAVAAHPGYAETGLHGAGPRAEGRRLAERLARLGSRVVAQSPEAGALPVLYAATAPGVPSDSFTGPSFAMWRGTPAPSWRASWTIDDAMGERLWAASERLTGVIYEALLP

SEQ ID NO: 11207 - protein, 301 aa, Escherichia coli CFT073
MDEIMTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYTLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 11208 - protein, 300 aa, Scrippsiella trochoidea
RIGRQVARIAMKDPEVELKLINASYDAEYLAYQMKYDSIHGRYDGTIEADGDSLVIDGHKVALSHTRDPAEIPFTEHGAEYVCESTGVFLTTEKIQPHLKAGAKKVIFSAPAKDDSHTVVMGVNQDTYESSMTAVSCASCTTNGLAPMVKAINDAFGIKRGLMTTIHAMTASQPTVDGSSKKDWRGGRAASGNIIPSSTGAAKAVAKVIPEVKGKLTGMAFRVPTIDVSVVDVTCELEKETSYEEICAEIKRRSEGDMKGFLGYCDEPLVSTDFETSPISSTFDAKAGIMLDPTFVKLVA

SEQ ID NO: 11209 - protein, 98 aa, Glycine max
  unsure (1)..(98): unsure at all Xaa locations
MATIDSMRARQMFHRRGNPTGEADSTRSDGTLARAACPSGAPTGRAEARESRDGRPDHQGKGASKAVDNVNTXLAPALNATDPTEQTAPDNGTDQQQD

SEQ ID NO: 11210 - protein, 672 aa, Neurospora crassa
MATRQMRKLQKQQELLRLKNEAEREDEESEDEPIVTKPKPNAFAGFAAFGGGDDGDDDQDTEEETKEAEDVPEPVAPAKKSKKSKKKKKKGKKTESPAPEKEEEDDLDEIDRVLEELKLKDNKNPVSDIATSNTANSTSQINELLRVNFQHLKAINEMRKLFGSAIEAARAEQAAEANSRQQQRGAARQNVDLETFLSVPPAVQQQLGKRSMFETVLRTNPFIEGKKTWPRDSTRGLKMVRVTESFNGEPGVAEFAFAHDKTYDALEGNFYGLVQMYDPMQLVYFLSRYPYHVSSLIQVSKVAHQDQNSYLAHDLIERALFTFGRVSLSDFRKRLGDGTARLDFNRPENRQFFLAGYNQIKNLVLKGTYRTALEWAKFVLSVNHDDPYGVLNWIHILAIRAYEAKWFIELCNSPLIANLGTGRYVKATLPLAKLQLKDNAGARAAAIESIEELPWLYCALFSALNIDTPRSVWGVQPRDDEEALHTKLYVHLAKDIWNNPAAISLLTEAANAARKVDFFGLPPSPVVSLATARFVYLDNTPELMSAVPAQDTQLRAVVDDARARIDDPEADEEQRGVWRRIVDVLTGQGWTGGAAGGAEGGEGNQRGDVMPGGWEDDFDDGWGDDDFEDEDHWYEDQLDPELELEFGQGGTPNRRATVEDADDTDEEETARR

SEQ ID NO: 11211 - protein, 462 aa, Glycine max
MAGLDMVAATAAANKDAPIPIFELLADAWADAWADAWADAWASSESSVEELGHHAGYYRLPRSKAARMFYFFFESRSSKNDPVVIWLTGGPGCSSELALFYENGPFQLTKNLSLVWNDYGWDKASNIIFVDQPTGTGFSYTSDESDIRHDEEGVSNDLYDFLQAFFKEHPQFTKNDFYITGESYAGHYIPALASRVHQGNKAKEGIHINLKGFAIGNGLTNPEIQYQAYTDYALDRGLIKKAEYNSINKLIPPCKQAIEACGTEGGETCVSSLYVCNKIFNRIMTIADDVNYYDIRKKCVGVLCYDFSVMEDFLNEKTVRDALGVGDLDFVSCSSTVYSAMMQDWMRNLEVGIPTLLEEGIKVLVYAGEEDLICNWLGNSRWVQAMEWSGQKQFGASGTVPFLVDGAEAGTLKSHGPLAFLKVYEAGHMVPMDQPKAALEMLRSWMQGKLTMTKSGDNVSPK

SEQ ID NO: 11212 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 11213 - protein, 353 aa, Oryza sativa
MNCSYVKDYEFVVIFDADFQPQADFLKRTVPHFKGKDDVGLVQARWSFVNKDENLLTRLQNVNLCFHFEVEQQVNGAFLNFFGFNGTAGVWRIKALEDSGGWMERTTVEDMDIAVRAHLKGWKFVFLNDVEVQSELPESYEAYRKQQHRWHSGPMQLFRLCFVDIIKSKQIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLEESNPKKDSKKKKHNRIYRKELALSFLLLTAAARSLLSAQGIHFYFLLFQGVSFLVVGLDLIGEQVE

SEQ ID NO: 11214 - protein, 295 aa, Cicer arietinum
MSSSFSFWTLCLILASLVSSSFCAAPRKPVDVPFGRNYYPTWAFDHIKYFNGGSEIQLHLDKSTGTGFQSKGSYLFGHFSMNIKMVPGDSAGTVTAFYLSSTNSEHDEIDFEFLGNRTGQPYILQTNVFTGGQGNKEQRIFLWFDPTKEFHRYSILWNMYQIVFFVDDVPIRVFKNSKDLGVKFPFDQPMKIYNSLWNADDWATRGGLEKTDWSKAPFVAGYKSFHIDGCEASVNAKFCATQGKRWWDQPEFRDLDAAQWRRLRWVRQKFTIYNYCTDRKRLPQIPPECTRDRDI

SEQ ID NO: 11215 - protein, 365 aa, Glycine max
MDWDGKEFAWDPRGLELLANGEGQKSEAASVDLRLGGEKIAPDVAKDTKESKTVSSPSGSSKRSRLQNGSQNMCCSVDGCNSDLSDCRDYHRRHRVCEKHSKTPVVLVGGKQQRFCQQCSRFHSLGEFDEVKRSCRKRLDGHNRRRRKPQPPSLFMAAEKFMYNYKGPRILHFGSPEAYANPIMRNMWPAAAKTGAESGYDPPRLLYRIDKHKQDKGHPLWQENDPKVGSGDEAMPGTPICQPIHGTIAPSTGGKSTRKLSTDAKPGSFDSGCALYLLSTLQSQSPELSMAQSSITCPMQSPSGSVHFDAVNEYSCSETEKDKPSGQVLVFDANTTNLHYNGMLQMGLDGLVENEDPLTLPFLWE

SEQ ID NO: 11216 - protein, 95 aa, Brassica oleracea var. gemmifera
MGRGRVEMKRIENKINRQVTFSKRRAGLLKKAHEISILCDAEVSLIVFSHKGKLFEYSSESCMEKVLERYERYSYAEKQLKAPDSHVNAQTNWSV

SEQ ID NO: 11217 - protein, 189 aa, Haemophilus somnus 129PT
MNTNLLVINNHDSFTYNLVDLIRRLGTPFKVVNVEDLSLVEIENFSHLLISPGPDVPHAYPQLFDLLEKYHQSKSILGVCLGHQTLCEFFGGKLYNLQNVRHGQAKQLKVRSNSRLFRNLPLTFQIGLYHSWAVSPENFPEDLEITAICDDEVIMAMQHKTLPIYGVQFHPESYISEFGKQIIQNWLSN

SEQ ID NO: 11218 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 11219 - protein, 374 aa, Photobacterium profundum
MRIKEFGVEIWMNEYENSCVYNLAETCVESLTVEQLLDMSGKRDCIINELLPMKLTYGAIEGSDRLRDNVTALYHNQKRSNILITHGAIGANALIHETLIEPGDRVVSVLPTYQQHYSIPESYGADVQVLKLKEENQFLPDLEQLQKLTTQNTRLITINNPNNPTGALMDESLLKRIVDIARACDAYILCDEVYRGTDAEGNGFTASIADLYEKGISTASMSKSFSLAGLRLGWIAAPEELIEKVCIHRDYNTISVGMLNDHFACIALECRDAILQRSRDICQTNRAVLDAWVKNEPLISYVKPTSGTIALLKYDLDMSSRDFCVKLLESKGVMFTPGSVLEMEGYVRIGYANNPQVLKEGLKKVSEFLAEISH

SEQ ID NO: 11220 - protein, 469 aa, Escherichia coli O157:H7
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 11221 - protein, 478 aa, Caloglossa leprieurii
LKNERYESGVIPYAKMGYWEPEYVTKETDVLALFRVTPQPGVDPIEAAAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAGTGEVKGHYMNVTAATMEDMYERAEFAKQLGTIIIMIDLVIGYTAIQTMAIWARKNDMILHLHRAGNSTYSRQKIHGMNFRVICKWMRMSGVDHIHAGTVVGKLEGDPLMIRGFYNTLLLPYLDINLPQGIFFQQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITFNYTSTDTADFVETPTANV

SEQ ID NO: 11222 - protein, 351 aa, Glycine max
  unsure (1)..(351): unsure at all Xaa locations
FSSSLFSNEFHGSGKVKIGINGFGRIGRLVARVALQRDDVELVAVNDPFITTDYMTYMFKYDSVXHGHWKHHDVTVKDEKTLLFGDKPVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 11223 - protein, 193 aa, Brassica oleracea
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTSTPPSQTQTVVVENPMSVNESGKLVSNVVVGVTTGQK

SEQ ID NO: 11224 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYERTHASTIAVMPVPHEDVSSYGVIAPQGEGINGLYSVETFVEKPAPEDAPSDLAIIGRYLLTPEIFDILENQAPGAGNEIQLTDAIDTLNKTQR

SEQ ID NO: 11225 - protein, 565 aa, Shigella flexneri 2a str. 2457T
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 11226 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQE

SEQ ID NO: 11227 - protein, 256 aa, Moritella marina
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 11228 - protein, 394 aa, Zea mays subsp. mays
  unsure (1)..(394): unsure at all Xaa locations
LGAARRARLPPGEMGWPLVGGMWAFLRAFKSDKPDAFIASFVRRFGRTGVYRSFIFSSPTVLLTTPEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPSFAYRGALRARRRLVAVLQGVLDERRXARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 11229 - protein, 516 aa, Triticum monococcum
MAMAMELLVSYPEVLLAIVSYLCLSLLRLILRCQKSGIPVKWPVVGMLPFLVRNRHHIHDKFAHALHEAGCNLMFTGPWFLDMDFFLSCDPATVNHCLSANFNNYPKGGEFAEMLDFLGNGIIVSDSESWEYQRHMAMHILGSRAYRTFSMSTITTKAGATLLPYLDGMARRGSEVELEGVFMRFLLDVTYTSAFATDLDGLSMSLPIPAFGQATKTAEEAVMFRHTVPRSLWKLLRALKVGSEKKMAGARVVIDRHIYQEIAKRKAHLLQGEEGDVLSMCIKWPMDPSMSEQHKTQFLRDTLLGFIFAAKDLTAVTLTWFFYMMCNHPHVEARIIEEITALLQLQSTTMPAGSLSVLDGDMLRQAVYLQAAFLETLRLFPASPFEEVEAVNDDALPNGTRLSKGTRIVFSLYAMGRLEGIWGKDCAEFRPERWLSKSGRLRHQPGYKFPAFNAGPRSCVGKDLALGSMKMIAASIIYNFKVQLVEGHAVMPGSSIVLHTRNGIMVSLKRREAAAA

SEQ ID NO: 11230 - protein, 310 aa, Pseudomonas aeruginosa PAO1
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPGRDPGEVARGWLNPRCRLVFVTHGGAGASVHCTHGSWSRPADTALPLRDTVGAGDTFQAATLAYLRRLDADSPAGLAALSREAIDAMLAFAIRAAAVTCSRVGPDLPFAHEL

SEQ ID NO: 11231 - protein, 573 aa, Pseudomonas aeruginosa UCBPP-PA14
MKRVFGYPGDGINGIMGAMGRRAEAFDYIRVRHEEMAAFMAGAHAKFTGEVGVCLATSGPGAIHLLNGLYDARMDHQPVLAIVGQQAATALGSDYQQEVDLQSLFKDVSAYVETVVSPAQLLHVLDRALRVAVGERQVATVIVPNDVQQMAAPKRQPHEHGHVMSAVGFVQPRPYARDADLEAAAAILNRGRRVAILAGAGALGAHRQLEAVAERLAAGVAKALLGKAAVSDDLPYVTGSIGLLGTRASSMLMEHCDTLLIVGSTFPYSEFLPKAGQARAVQIDLYPRNIGIRYPIDQALLGDAGETLERLLPLLEQKKHGAWRRRVERAVTASREEARRQAEEPADPINPQRVFRSLSEQLPDDAILCGDSGSHTNWYARDIRMRPGMLGSLSGKLATMGSGVPYAIAAKLAYPQRPVVAMVGDGAMQMNGNAELVTVQQYWQRWDSPTFIVLVLNNGDLNQVTWEQRALAGDPEFSPAQEVIDFPYARYADMLGFKGIRVDRPEDIDAAWAEAFAADRPVLLEVVTDPNVPPLPPHISFEQAKHLLGAMLQDDPKRWGVIRQSARQVLARH

SEQ ID NO: 11232 - protein, 284 aa, ASPERGILLUS NIDULANS FGSC A4
MATSTKQTYPVLPKNLLLISLKMYFEPSRTLEYCRALLDPKNDIVRPENRSKLLLALIPDFLTIYPCAEIIKEYVSTLPKDDSPSLPAPFLLGAQDCFWEPLGAYTGEVSPLSLSSLGVSIVELAHAERRSIFGETDEQAARKAAAACAQGMVPLVCIGEISAPGPVASAAVGLAVRECEPLVRAILNAIPADAPIIFAYEPVWAIGKPKPASVDHISAVVDGLRALIGRRSGDVRILYGGSAGPGLWGPGGLGKAVDGMFLGRFAHDIEGVRKVVREVEESLT

SEQ ID NO: 11233 - protein, 226 aa, Neurospora crassa
MSANAESAPQAADLVTSTQDNTANTQSTISQDAAGLESSSSPAAAAELASTKVKLMAALRSFPDFPIPGINFIDILPLFQDVKTHEALLVALQLQIELSHQKPDVIVGLDARGFLFGPSLALRMGASFVPVRKQGKMPGPCVTAAYEKEYGTDFFQMQDGAIKPGQKVLIVDDIIATGGSAAAAGELVKKLGGETIGYLFILEIAFLKGREKLGGVPVTTLLETDE

SEQ ID NO: 11234 - protein, 318 aa, Pelargonium x hortorum
MESFPVINMEKLNGEERAATMEKIKDACENWGFFELLNHGIPYELLDTVEKMTKEHYRKCMEQRFKEMVASKGLEGVEVEVEDLDWESTFFLKHLPESNISQVPDLQDEYRKVMKEFAAKLEKLAEELLDLLSENLGLEKGYLKKAFYGSKGPTFGTKVSNYPPCPKPDLIKGLRAHTDAGGLILLFQDDKVSGLQLLKDGKWVDVPPMHHSIVINLGDQLEVITNGKYKSIEHRVIAQSDGTRMSIASFYNPGSDAVIYPAPALLEKETEEKQVYPKFVFEDYMKLYSGLKFQAKEPRFEAMKAVEANVTLDPIRTA

SEQ ID NO: 11235 - protein, 514 aa, Verbena x hybrida
MTFSELINILFWDLTAAILLYVALILVCSLYSKPSTVSRNLPPGPKGFPVVGALPLLGTMPHIALAKMAKTYGPVMYLKVGTWGMAVASTPDAARAFLKTLDTTFSDRPPNAGATLLAYNAQDMVFAHYGPRWRLLRKLSNLHMLGAKALEDWADVRSSEVGHMLQAMLTSSLRHEAVALPEMLIYSMANMIGQVILSRRVFETKGKEVNEFKDMVVELMTSAGYFNIGDFIPALAWMDLQGIEKGMKSLHKKFDDLIGRMLDKHLESAHKRNAKPDFLDVILANRHNSEGESLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSGKNAKIDPRGNNFELIPFGAGRRICAGARMAMVLVEYILGTLVHSFDWELPVGVDEMDMEEAFGLALQKAVPLAAMVSPRLPPHCYAP

SEQ ID NO: 11236 - protein, 412 aa, Lactococcus lactis subsp. cremoris
MDTGSIAFILICAALVLLMTPALAFFYGGLGRRKNVLNTMMMSLAPMALASIYGLIIGFHFFSGNNSWIGNFDHLFMNGVHMAKNSLFPANHIPDGLFSGFQMMFSIITVALITGSVVGRMRFTPILLFMGAWLILVYYPLAHMVWGGGFLAQIHAIDFAGGDVVHISNGVTGLVLALVLGKRRDYERLDYRPHNIPFVVLGAGLLWFGWFGFNAGSALAANGVAINAFMTTNTAAAAAMLSWMIIEKIMIGKPSVIGACSGAVVGLVAITPGAGFVSLWSSIIIGLLVSPLSYFMISVVKKKFGYDDALDAFGCHGIGGMFGGIMTGIFATPALAPEKGYVGLVYGSGKLLLANLTAVVFTVIFTALVSWIIIKVIGLIMPIPVTDRAEAIGLDDSEHEETAYPTFLGLDS

SEQ ID NO: 11237 - protein, 175 aa, Glycine max
  unsure (1)..(175): unsure at all Xaa locations
MSARLMKKVLNEQHHLPQHVSGEEEEEEEENDSEPITRSSINPFDLLNDNDSEPEDQGDELMSTNERLASYDDEEESSSLKPTAEVSTSIPKSKKKKKKKNKDSAVVNKTGEDKELDLILENLSLNVNSSAEQPVSTKDKNKSVKQQAASILQVDXKCLNAENELRRIFGSKVVK

SEQ ID NO: 11238 - protein, 316 aa, Tulipa gesneriana
MASFPVINLEKLEGGERSKVMEVLHDACANWGFFELLNHGISHELLDKVEKLTKGHYKKCMEERFREFASKTLQDVSKVDVDNLDWESTFYLRHIPTSNMSEIPDLSDEYRETMKEFVLSLEELAEQLLDLLCENLGLEKGYLKKAFSGSKGPTFGTKVSNYPPCPKPELIKGLRAHTDAGGLILLFQDDKVSGLQLLKDGEWVDVPPMHHSIVINLGDQIEVITNGKYKSVLHRVLAHPDGTRMSIASFYNPGSDAVIYPAAALLEEVENQSEVYPKFMFEDYMKLYAVQKFQAKEPRFETMKAMKIANVQPIAT

SEQ ID NO: 11239 - protein, 99 aa, Zea mays; identical to SEQ ID NO: 3237

SEQ ID NO: 11240 - protein, 204 aa, Hypocrea jecorina
MSDSPQSPPKDVDQGAQSPDEEGQMNDNQEPHSAGGTGYEFEGVKEQDRWLPIANVARIMKNALPDNAKIAKEAKECMQECVSEFISFITSEASEKCQQEKRKTVNGEDILFAMTSLGFENYAEALKVYLSKYREQQNQSNRDRVLENNTWGNAMIPGEKTEPGTTNPEYAPPEGANPPESGAEPNYMYTSHAGHNGAGAGENY

SEQ ID NO: 11241 - protein, 380 aa, Streptococcus pneumoniae R6
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDNVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSRGAQVREGAEVLDSVIMSGAIIGQGAKIKRAIIGEGAIISDGVEIDGTDEVQVVGYNEVVGVATDED

SEQ ID NO: 11242 - protein, 456 aa, Mychodea hamata
YVIKENDVLALFRVSPQPGVDPIEASAAVAGESSTATWTVVWTDLLTACDLYRAKAYKVDTVPNTSDQYLGFISYDIDLFEEGSIANLTASIIGNVFGFKAIKALRLEDMRIPVAYLKTFQGPATGIISERERMDKFGRPFLGATVKPNLGLSGKNYGRVVYEGLRGGLDFLKDDENINSQPFMRWKERYLYAMEGVNRSIAATGEVKGHYLNVTAATMENMYERAEFAKQLGSVIIMIDLVIGYSAIQSMGIWARKNDMILHLHRAGNSTYSRQKIHGMNFRVICKWMRMAGVDHIHAGTVVGKLEGDPLMIRGFYNTLLLSYLKPNLPQGIFFEQDWASLRKVTPVASGGIHCGQMHQLLDYLGVDVVLQFGGGTIGHPDGIQAGATANRVALESMVMARNEGRDYVAEGPQLLQDAAKTCGPLQTALDLWKDISFNYTSTDTADYAETPTANV

SEQ ID NO: 11243 - protein, 405 aa, Mycobacterium tuberculosis H37Rv
MRSVQEHQRVVAEMMRACRPITVPLTQAQGLVLGGDVVAPLSLPVFDNSAMDGYAVRAEDTSGATPQNPVMLPVAEDIPAGRADMLTLQPVTAHRIMTGAPVPTGATAIVPVEATDGGVDSVAIRQQATPGKHIRRSGEDVAAGTTVLHNGQIVTPAVLGLAAALGLAELPVLPRQRVLVISTGSELASPGTPLQPGQIYESNSIMLAAAVRDAGAAVVATATAGDDVAQFGAILDRYAVDADLIITSGGVSAGAYEVVKDAFGSADYRGGDHGVEFVKVAMQPGMPQGVGRVAGTPIVTLPGNPVSALVSFEVFIRPPLRMAMGLPDPYRPHRSAVLTASLTSPRGKRQFRRAILDHQAGTVISYGPPASHHLRWLASANGLLDIPEDVVEVAAGTQLQVWDLT

SEQ ID NO: 11244 - protein, 366 aa, Brassica napus
MFKQESNNICNRENNRGARACDTCGSTICTVYCHADSAYLCNSCDAQVHSANRVASRHKRVRVCESCERAPAAFMCEADDVSLCTACDLEVHSANPLARRHQRVPVVPIIGNSCSSLATANHTTVTEPEKRVVLVQEDAKETASWLFPKNSDYHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 11245 - protein, 165 aa, Aegilops sharonensis
VMASSATTVAPFQGLKSTAGLPVSRRSSASLGSVSNGGRIRYMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 11246 - protein, 549 aa, Malus x domestica
MWDLNDSPDQRPRGEESEGCSSQKTSADGDEEKRKRVGSVSNSSSSAVVIEEDGSDQEEDQDDGPTKLAKKQGGGGGKIFGFSVAHEESMDSDPPATVTRQFFPVELDYSSSSNLDVMGPAEGGGSIPPPPSTSSSFPRAHWVGVNFGQSDSGSPGNPPPAGEASHQPMKKSRRGPRSRNSQYRGVTFYRRTGRWESHIWDCGKQVYLGGFDTAHAAARAYDRAAIEFRGVEADINFSIEDYEEDLKQMRNLTKEEFVHVLRRQSTGFPRGSSKYRGVTLHKCGRWEARMGQFLGKTYVYLGLFDTEVDAARAYDKAAIKCNGKEAVTNFDPSIYDNELNSSESSGVIAADHNLDLSLGSTNSKKNNQALGNDHHSQNVAMEHQHSVSMQLDANWRSQGLRPKLNIQRDRSRDDIDAQRRDGYSESEAMQLLLRTNLQSQAPAEVHKYGQFNRRLTAGDIQMSHNFPPNFNSPNYHHIQFPSSSEGGGRIGSDLSLSTSDHQQQWQSATPTSNLFATAAASSGFPPQLRPLPTQNSWLQKNGFHTLARR

SEQ ID NO: 11247 - protein, 369 aa, Oryza sativa
MAALSSRRRHGSLRLLAVALLVLAGVASSAAAAGSGRGAFDPSRVVQLSWRPRAFLHKGFLTDAECEHLISLAKDKLEKSMVADNESGKSVMSEVRTSSGMFLEKKQVVFFCSLREMKFDQLFPIYISIVCKALNHVVIFAIWTSILSNRPVLKLDEVVARIEERIAAWTFLPPDNGESIQILHYQNGEKYEPHYDYFHDKNNQALGGHRIATVLMYLSDVGKGGETIFPEAEGKLLQPKDDTWSDCAKNGYAVKPVKGDALLFFSLHPDATTDSDSLHGSCPVIEGQKWSATKWIHVRSFDISVKQGASTDGCEDENVLCPQWAAVGECAKNPNYMVGTNEAPGFCRKSCNVCAHCRIEWNTYALAYV

SEQ ID NO: 11248 - protein, 502 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPA

SEQ ID NO: 11249 - protein, 293 aa, Zea mays
YAPLVDELWKDPAIQATYRRSELPFLPPAASYFLDKAVDISRTEYELSDMDILYADGITSSDGVASTEFSFPQLSLGGLGVDEPDAQDTLLRYQLIRINSRGLHGNCKWLQMFDDVRLVIFCVAASDYDEFYEDANGTIVNKMVESRQLFESITLHPTFEQADFLLLLTKFDLLEQKISSSPLTSCDWFSDFTPLISRNLLNGGSGGRRRTARSSTGATLPQMAAHYMATKFKRLFESMTGRKLYVSYVNALDQESVRSAIRYGREVVKWEEEKPVFGASETVYSEEPSSFTA

SEQ ID NO: 11250 - protein, 263 aa, Magnetococcus sp. MC-1
MCHVLPSVGEKALLQTPILTTIPPNRYDPYDLLPGSETSMIKIAPSILSADFARLGEEIRMVEAAGADYIHVDVMDGHFVPNLTMGPPVVASIRKVATKPLDVHLMISPVDPYIEAFAQAGSDIITVHAEATHHLDRTLNLIKEYGKKAGVSINPATPVSAIENVMHLVDMVLVMSVNPGFGGQSFIPHSLNKVRQVREMINRQDRPIELQVDGGVKPDNIAKIAEAGANVFVAGSAIFSQPDYRAVMDSMHKNVRDSQKNPD

SEQ ID NO: 11251 - protein, 379 aa, Zea mays
QIAEAEILEDQLLVALGHRILELVDKLEDFDLILLPSFELERPLQLAKEAIGIRYLSPYEVGTCPICREEKLGSQMIKAGCSHTYCYNCLTGYVEEKLLTSKLPIRCPQLRCKYIISASECKSFLPVSSYDSLERAFAEAGTSGMERFYCPFPNCSVLLDLSQHFSRASSSSQSDLSCVECPECHRDICINCGVPWHIMMGCDEYQSLPAEERDAGDLSLHRLAQNNRWRRCQRCRRMIELTQGCFHMTCWCGHEFCYSCGADYASGVQTCQCVFWDDEAMEPSSAARSTQAASEIWAWDTFDCMPTAVEGYSEQERAQLALIQRFLAGGFSLGENPCQSPPRCADSYIVDTMKDLHQLPWLERFVSVISDTYNDDYMQ

SEQ ID NO: 11252 - protein, 366 aa, Emericella nidulans
MTSQRPTSSSSSLLDIVANLASPKSLLFNAHHTNPPPSLPSQRAPTMDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 11253 - protein, 270 aa, Zea mays
FGSSTHEEIEDMTNSYRIKIGAGGFGAVYKGELPSGSQVAVKKIEGVGMQGKREFCTEIAVIGNIHHVNLVRLRGFCTEGQRRLLVYEYMNRGSLDRSLFRPTGPLLEWKERMDVAVGAARGLAYLHFGCDQRIIHCDVKPENILLADGGQVKIADFGLAKFLTPEQSGLFTTMRGTRGYLAPEWLSNAAITDRTDVYSFGMVLLELVRGRKNRSEHVSDGGGEASNSSNGTAGSSSRGAKSDYFPLAALEGHEAGQYAELADPRLQGRV

SEQ ID NO: 11254 - protein, 457 aa, Dictyopteris undulata
DYNVKDTDILALFRITPQPRVDPVEAAAAVAGESSTATWTVVWTDLLTACDIYRAKAYRVDPVPGTTDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLRGGLDFLKDDENINSQPFMRWKERFLYCMEGVNRAAAATGEVKGSYLNVTSATIEQMYERAEYADSLGTVIVMVDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMVLARNEGRDYVEEGPEILRKAAVTCGPLKAALDLWKDITFEYTSTDTPDFVEVPTAGT

SEQ ID NO: 11255 - protein, 653 aa, Zea mays
  unsure (1)..(653): unsure at all Xaa locations
MDQHDSMADSQRRRHNLLRDKVQLVKRKYSDRYEIVRFHDPLSFEKGFFVVIRACQLLAQHNDGIIFVGVAGPSGAGKTVFTEKVVNFMPDVAVISMDNYNDATRIVDGNFDDPRLTDYDTLLENIHGLKEGRSVQVPIYDFKSSCRTGYRTVDVPSSRIVIIEGIYALSEKLRPVIDLRVSVTGGVHFDLVKRVLRDIQRAGQEPEEIIHQISETVYPMYKAFIEPGLETAHIKIINKFNPFSGFQNPMYILKSPRSLXPEKIKAVLGDDHTESNEETYDIYLLPPGEDPEACQSYLRMRNREGKYNLMFEEWVTDNSFIISPRITGEVSVRLLGGLMALGYTIAAILKRSTRVFSDGKATVKIDWLEQLNRQYIQVQGRDRLYVKSVADQLGLDGSYIPRTYIEQIQLEKLINDVMALPEDLKTKLSIDDELVSSPKEAFSRVSADRRNKLMKSGLSQSYSTHGDKNIVKLSKLTETNRRFGGGRALEPPAINQGAITQLSEQISTLNERMDEFTSRVEELNSKFTVKKHLPSQQNLALPNDACNGFTPTNLFVSHLSNGTLIPHSSSSNQLSKDSPMIEEIMNITRGQRQVIHQLDNLTNLLHEHLVLTRQTNNTASRNRVLDSDTLICPLICLTVASIGYFMFKGLSRG

SEQ ID NO: 11256 - protein, 250 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 11257 - protein, 374 aa, Glycine max
APPPRLMPDLSTLTRIPWNKQDEMVLADMCVKPGEAWEYCPRDALRRASKILKDEFDLEMNAGFENEFILLKSITREGKEEWIPFDSSPYCSSSAFDAASPILHEVAASLHSLGISVEQLHAEAGKGQFELVLKYTVCTKAADNLTFTREVVRAIARKHGLLATFIPKYALDDLGSGSHVHLSLSRNGQNVYMASDRSSKHGISTLGKEFMAGILHHLPSILAFIAPLPNSYDRLQPNTWSGAYLFWGNENKEAPLRATSPPGTPDGLVSNFEMKSFDGSANPYLGLAAILAAGIDGLRRKLSLPEPVDTNPNPETLQRLPASLSESLDALNKDDFLKEFMSDKLLTTIKAIRKAEIDHYTKHKDAYKQLIHRY

SEQ ID NO: 11258 - protein, 362 aa, Pseudomonas aeruginosa UCBPP-PA14
MPALRGARRGDPHPAPGATTGSLRTGLPALPGAPASAIMAGFPSSSGVLEICMYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPDRDPGEVARGWLNPRCRLVFVTHGGAGASVHCTHGSWSRPADTALALRDTVGAGDTFQAATLAYLRRLDADSPAGLAALSREAIDAMLAFAIRAAAVTCSRVGPDLPFAHEL

SEQ ID NO: 11259 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 11260 - protein, 316 aa, Arabidopsis thaliana
MDSRIFLAFSLCFLFTLPLISSAPNRFLTRSSNTRDGSVIKMKTSASSFGFDPTRVTQLSWTPRVFLYEGFLSDEECDHFIKLAKGKLEKSMVADNDSGESVESEVRTSSGMFLSKRQDDIVNNVEAKLAAWTFLPEENGESMQILHYENGQKYEPHFDYFHDQANLELGGHRIATVLMYLSNVEKGGETVFPMWKGKATQLKDDSWTECAKQGYAVKPRKGDALLFFNLHPNATTDSNSLHGSCPVVEGEKWSATRWIHVKSFERAFNKQSGCMDENVSCEKWAKAGECQKNPTYMVGSDKDHGYCRKSCKACSS

SEQ ID NO: 11261 - protein, 141 aa, Oryza sativa
MISAKRLVQLAKKWQRMAALGRKRIMGKAQETEECSTSVAVKGHCVMYTADGRRFEVPLAYLGTAVFSELLRMSQEEFGFTSDGRIVLPCDAAEMEYAMCLLKRNPSVEVVDALLSSMPMRCHCTGRMVPTGGVNQQISCL

SEQ ID NO: 11262 - protein, 416 aa, Ralstonia metallidurans; identical to SEQ ID NO: 317

SEQ ID NO: 11263 - protein, 363 aa, Triticum aestivum; identical to SEQ ID NO: 10951

SEQ ID NO: 11264 - protein, 849 aa, Synechocystis sp. PCC 6803
MEHLPMAFNTTNPLIQVEDDRTGLSVETLKRALADNLFYLQGKFPAIATKNDCYMALAYTIRDRLLQRWLNTFQTYLNCDNRVVCYLSAEYLLGPHLGNNLINLGLWEPVQQAVEESGLSLDELIDIEEEPGLGNGGLGRLAACFMDSLATLEIPAIGYGIRYEFGIFDQEIKDGWQVEITDKWLQLGNPWEIARPESAVLVKLGGHTEPYTDDQGNYRVRWIAGSLVKGIPYDTPILGYKVSTANNLRLWKSEAAESFDFQRFNVGDYYGAVQDKMSSENLTKVLYPNDEQIQGKELRLAQQYFFVSCSLQDMIRIHLSDNPTLENFHEHFAVQMNDTHPSIAVAELMRLLVDEHHYEWQRAWAITEATFGFTNHTLLPEALEKWSLPLFGEMLPRHLEIIYEINQRFLDQVRMKYPNDGDRLARLSIIDEAGEKSVRMAYLATVGSHAINGVAALHSQLVKETILKDFYELWPEKFSNKTNGVTPRRWMVLSNPRLSNLISSRIGDGWIKNLDELKQLEPFADLAGFRQDWCKVKREVKQDLARYIHTRTDLVVNPDSLFDVQVKRIHEYKRQHLNILHVIHLYLQIKNNPNLDVTPRTFIYGGKAAPGYFTAKLIIKLINSVADVVNNDPTIGDRLKVIFLPDYNVKFGQRVYPAADLSEQISTAGKEASGTGNMKFSMNGALTIGTLDGANIEIREEVGAENFFLFGLTTPEVEKTLAEGYQPWEYYNNNANLKAVVDLINSGFFSHGDTALFRPLMDSLLGQDPYLVFADFQAYVDCQNQVGEAYKDQENWARMAILNVARMGKFSSDRTIREYAEDIWAIKPVVIELEDLCPDGQCLLISPNK

SEQ ID NO: 11265 - protein, 63 aa, Brassica napus
  unsure (1)..(63): unsure at all Xaa locations
YPDLKGINFDLPHVIEEATSHPGIDHVGGDMXVSVPKGDAIFMKWICHDWSDEHCVKFLKNCY

SEQ ID NO: 11266 - protein, 827 aa, Oryza sativa
MKLRFAEAADDDDGGDGGAGDYQGWGRIMTQADQAVISLRPGGGGGIGGPRAGRLFPFGASTGSLDFLRPRGGASSGFAAKLGDLRFEPLERVRYTRDQLVELHEIIDIPENILKLKQDIDIELHGEDEPWINNDSSVQTQSYNRYAETDNRDWRSRIEQPVQTPAIGGEEKSWDKFREAKESYISSGKQDQFNNQDKLSSQFSAKAQVGPAPALVKAEVPWSIQRGNLSNKERVLKTVKGILNKLTPEKFDLLKGQLIEAGITTADILKDVISLIFEKAVLEPTFCPMYAQLCFDLNEKLPSFPSEEPGGKEITFKRVLLNNCQEAFEGADNLRSEVNKLTGLDQEMERRDKERLVKLRTLGNIRLVGELLKQKMVPEKIVHHIVQELLGSESNRCPAEENVEAICQFFNTIGSTASIRTGRTGTGGGGPLSPGAFSMNQPGIVGMLPGMPGARKMPGMPGLGSDDWEVPHSRSKPRADPVRNLTPSLANKPSPNNSRLLPQGSAALISGKTSALVGSGGPLSHGLVVTPSQTTGPPKSLIPAPSVDPIVEQPAAAPKPSSTELQKKTISLLKEYFHILLLHEAQQCIEELKSPDYYPEVVKEAINLALDKGTNSIDPLLRLLEHLYNKNVFKATDLETGCLLYSSLLDELAIDLPKAPVHFGEVIGRLVLSHCLSIEVVEDTLKKIEDSFFRAAVFEAMMKIMKANPSGPYLCAAFSKSVASDPPALSMRLVAGWLLCACAGDGALCPACDTWLHPWLAGHFLIARSRRLPQCHAVLAPGADAAALRPPLGSLAASPLLASTFPLVRRLRSSRQQPHRRWGLGSG

SEQ ID NO: 11267 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGSAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 11268 - protein, 504 aa, Zea mays
  unsure (1)..(504): unsure at all Xaa locations
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLXGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKAPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 11269 - protein, 574 aa, Escherichia coli O157:H7
MEMLSGAEMVVRSLIDQGVKQVFGYPGGAVLDIYDALHTVGGIGHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQTLVAAKKPVVYVGGGAITAGCHQQLKETVEALNLPVVSSLMGLGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGGAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPQELESKLSEALEQVRNNRLVFVDVTVDGSEHVYPMQIRGGGMDEMWLSKTERT

SEQ ID NO: 11270 - protein, 75 aa, Glycine max
SGPICYQRNRAGAGMVAPFTVLKSMAGFPTRNTNNDITSIASIVGRVQCMHVCPPIVKKKFETLSYLSDLDYAQL

SEQ ID NO: 11271 - protein, 357 aa, Xanthomonas campestris pv. campestris str. ATCC 33913
MSKQILILPGDGIGPEIMAEAVKVLTRIDTQHTLGVTLVYDELGGAAYDKYGSPLADETLERARAADAVLLGAVGGPQWDTIDPALRPERGLLKIRSQLGLFANLRPALLYPQLADASTLKPEVVSGLDLLILRELTGGIYFGQPRGTRTLDNGERQAYDTLPYSESEIRRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGQGIANPLATILSVAMMLRYTFAQAAAADAIEAAVGKVLDQGLRTADIWSEGTTKVGTAAMGDAVVAAL

SEQ ID NO: 11272 - protein, 334 aa, Corynebacterium glutamicum ATCC 13032
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 11273 - protein, 457 aa, Cladostephus spongiosus
DYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNVTAATIEHMYERAEFAESVGTVIVMIDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLPYYLGDDVVLQFGGGTIGHPDGIQSGATANRVALEAMVLARNEERDYVSEGPEILRVAAATCGPLKAALDLWKDITFEYTSTDTPDFVEVATESN

SEQ ID NO: 11274 - protein, 192 aa, Zea mays
VYTFYFIGMDLPLEAEAADKRRFGATLALSMAFIAVMYGLFGAMGYLAFGADTRDMITTNLGTGWLSVLVQLGLCINLFGSRPVMMNPVYEVAERLLCGKRYAWWLRWILVVLVGLLAMLVPNFADFLSLVGSSVCVVLGFVLPAVFHLKVFGTEIGWAGLVADVAVIVIGIALAVSGTWTSLVQIFSSSDL

SEQ ID NO: 11275 - protein, 490 aa, Helianthus tuberosus
MDFLIIVSTLLLSYILIWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSGKEFREVITNIMVDSAKTNLVDVFPVLKKIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 11276 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 11277 - protein, 222 aa, Bacillus anthracis str. A2012
MKFFIDTANLEDIKKAYKLGVLAGVTTNPSLVAKEGIKFEDRIAEICQAVPKVESVSAEVTPDAVTAEEMIAQAEELIKINGGDEKVTIKLPMTLAGLEACRYLTEKGVKTNVTLIFTVNQALLAARAGATYVSPFLGRLDDISEDGVLLVAKIAELFDVHQLDTQIIAASVRHPDHVTRVAMAGAHIATIPYKVIEQLAMHPLTDQGIEKFAADWAKAPKL

SEQ ID NO: 11278 - protein, 361 aa, Pyrococcus furiosus DSM 3638
MQAVVLAGGKGTRLLPLTVYRPKPMIPFFNRPIMEYIVESLVKFGVDEIIVLVGYLKERIFEYFGNGEEFGVEIKYSNGENLKLGTAGALKKAEKLIQDTFLVVSGDILTNLDFRSLVEYHKKKGGPATIALTKVEDPSAYGVAVLDKEGRISYFKEKPKREEAPSNLVNAGIYVFEPEIFDLIPKGKNFDFSLDLFPKMLNENIPIYGYPFDEYWNDIGRPSTYLQATEDVFLGKLRLPQINVGSLKGNIEKGGSLFTGSRCILRRPRIIGFAVLGNNVEISKDVTIERSVIFSNVTIEEGAEIREAIIGENVYIGKGVVIEPGSVIGDNSIIEDFSKVGANVKIWADSRIGKESIILPD

SEQ ID NO: 11279 - protein, 221 aa, Leymus cinereus
GRRRVEMEDRHVAKLALGGDPEVALFAVFDGHGGKNAAEFAAQNMPKFMAEEVRKVDGGDSDEIEGAVKKCYLKTDEEFLKREESGGACCVTALLQKGGLTVSNTGDCRAVLSRSGTAATLTSDHRASREDERERIENLGGFVVNNRGTWRVQGSLAVSRGIGDAHLKQWVVADPDTRTLLVDPQCEFLVLASDGLWDKVDNQEAIDIARPLCIGNDKASR

SEQ ID NO: 11280 - protein, 467 aa, Musa acuminata
MADAKIAKLQSAVAELNQISENEKSGFISLVSRYLSGEAEQIEWSKIQTPTDEVVVPYDTLSPPPEDLEATKKLLDKLAVLKLNGGLGTTMGCTGPKSVIEVRNGFTFLDLIVIQIESLNKKYGCNVPLLLMNSFNTHDDTQKIVEKYANSNIEIHTFNQSQYPRLVMEDFQPLPSKGHAGKDGWYPPGHGDVFPSLMNSGKLDALLSQGKEYVFIANSDNLGAIVDIKILNHLINNQNEYCMEVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLLLVQSDLYMLVDGFVIRNKARTNPSNPSIELGPEFKKVANFLSRFKSIPSIVELDSLKVSGDVWFGEGVVLKGNVSIAAKSGVKLEISDGAVLENKVINGPEDI

SEQ ID NO: 11281 - protein, 322 aa, Streptococcus pyogenes MGAS8232
MVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGIPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 11282 - protein, 171 aa, Prochlorococcus marinus subsp. pastoris str. CCMP1378
MEILNELISTYKDHPKEGIDFKDVLEIVQHPIVFKELILKMASSKIVSNAEALISIDARGFIFGSAISFQVSKPMIFARKPGKLPGELIKKKYTLEYGENSLSIQKKSLNNFYSFAIIDDLLATGGTVNCVSNILKDNGKKITGLLTVVELIELEGRSKFDFPVESWLKCK

SEQ ID NO: 11283 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 11284 - protein, 378 aa, Oryza sativa (japonica cultivar-group)
MARRSAPLLQRLLSPTPSPSPSPPHPLAAAAVSRRTVTYMPRPGDGAPRAVTLIPGDGIGPLVTGAVRQVMEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 11285 - protein, 419 aa, Neurospora crassa
MPALTGIAVSAALAVTTRRTHLGVGTVVMGIEGFNVESSLRIPMTSREAFHKFLRSASPSSSQSPRSLSPAAQGTNRVARAPYLLRSQAVLVTTLTPPSFGVTQPKVLENPPIPISPSKRTWRRRDGTAAEGQTTFFASTRAPSFSPIVPSSAPSHHATNTFFLATSFSRLYKKAVLSRSTKRVDRIARDTIATSSSSINHTSNMSSVVNEGEKPQEAAQEQQEEQQQQQQQQEQQNAGDDVNDDEEEISAMKRRVAEMEEEAAKLREMQASLDQQHHELTENKEDIDSRSIFVGNVDYSASPEEIQAHFQSCGSINRVTILLDKFTGQPKGYAYVEFTEPSLVAQALVLNESVFKGRNIKVVPKRTNIPGMSRGGRGGRGSFRGGGRGGYFGGRGGFPPRGGYRGGYRGRGRGGYAPY

SEQ ID NO: 11286 - protein, 524 aa, Candida tropicalis
MATQEIIDSALPYLTKWYTVITLAALVFLISSNIKNYVKAKKLKCRDPPYFKGAGWTGISPLIEIIKVKGNGRLARFWPIKTFDDYPNHTFYMSIIGALKIVLTVIQENIKAVLATQFTDFSLGTRHAHFYPLLGDGIFTLDGEGWKHSRAMLRPQFARDQIGHVKALEPHIQILAKQIKLNKGKTFDIQELFFRFTVDTATEFLFGESVHSLYDEKLGIPTPNEIPGRDNFATAFNTSQHYLATRTYSQTFYFLTNPKEFRDCNAKVHYLAKYFVNKALNFTPEEIEEKSKSGYVFLYELVKQTRDPKVLQDQLLNIMVAGRDTTAGLLSFAMFELARHPEIWSKLREEIEVNFGVGEESRVEEITFESLKRCEYLKAILNETLRMYPSVPVNSRTATRDTTLPRGGGPNGTDPIFIPKGSTVAYIVYKTHRLEEYYGKDADDFRPERWFEPSTKKLGWAYVPFNGGPRICLGQQFALTEASYVITRLVQMFETVSSPPDVEYPPPKCIHLTMSHDDGVFVKM

SEQ ID NO: 11287 - protein, 307 aa, Salmonella typhimurium
MNAKVWVLGDAVVDLLPESEGRLLQCPGGAPANVAVGVARLGGNSGFIGAVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 11288 - protein, 226 aa, Clostridium tetani E88
MVIIDLLKGVVYMKFFIDTANVEEIKKVAKWGVLDGVTTNPTLIAREGRDLKEVIEEICSIVDGPISAEVISLESEKMVEEAKELIKIHKNIVIKVPMCEEGLKAVSELTKLGIKTNVTLIFSAQQALLAAKAGATYVSPFLGRIDDIGSFGIQLVEDIVTIFTNFGIESEIICASIRTPIHVLECARVGGDIATVPYKVFAQMLKHPLTDRGIEQFLEDYKSMNK

SEQ ID NO: 11289 - protein, 99 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDP

SEQ ID NO: 11290 - protein, 486 aa, Streptomyces coelicolor A3(2)
MSSYFTDLAQQYIDGEWRPGTGSWDIIDFNPYDNEKLASITIATVDEVDAAYRAAERAQRQWAATNPYARRAVFEKALRLVEEREAEIGEAIVAELGGTRLKAAFELHLAKEFLREAVHLALAPEGRIIPSPVDGKENRVYRVPVGVVGVISPFNFPFLLSLKSVAPALALGNAVVLKPHQNTPIVGGTLVAKILEDAGLPGGLLNVVVTDIAEIGDAFIEHPVPKVISFTGSDKVGRHVATVCAANFKRSVLELGGNSALVVLDDADVDYAVDAAVFSRFVHQGQVCMAANRVLVDRAVADEFTEKFVAKVSGLKVGDPRDPSTVIGPVINSSQADALSGVVEQALAEGATALVRGSVTDNLVEPSVLTGLPADSALLRQEVFGPVAFLVPFDGEEEAVRLVNDTPYGLSGAVHTGDVERGVNFAKRIDTGMFHVNDGTVHDEPIVPFGGEKHSGLGRLNGDTMLDAFTTQKWISVQHGRSGFPF

SEQ ID NO: 11291 - protein, 273 aa, Triticum aestivum
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 11292 - protein, 546 aa, Escherichia coli CFT073
MTPGEVRRLYFIIRTFLSYGLDELIPKMRITLPLRLWRYSLFWMPNRHKDKPLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVATLEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 11293 - protein, 429 aa, Mycobacterium tuberculosis H37Rv
MPIIEQVRAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 11294 - protein, 187 aa, Thuja standishii
ICTYFAQPLHQRDYSRWPVKPEGWREIVDKYSEALMGLAKKMLAIVSEALGLEPDAVTKACVEMDQKVVINYYPKCPEPDMTLGLKRHTDPGTITLLLQDQVGGLQATKDNGLNWITVQPVQGAFVVNLGDHMHYLSNGKFKTADHQAVVNSNYSRLSIATFQNPSQDAIVYPLKLEEGEECFMEEP

SEQ ID NO: 11295 - protein, 321 aa, Zinnia elegans
VIKVICCGVCHTDLHQIKNDLGMSNYPMVPGHEVVGEVVEVGPDVTKFNVGDCVGVGCLVGCCNNCRPCNADVEQYCNKKIWTYNDVYTDGKPTQGGFAGSMVVHQKFVVKIPEGMAPEQVAPLLCAGVTVYSPLNHFGMKGSGLKGGILGLGGVGHMGVLIAKAMGHHVTVISSSDKKKEEALDVLGADDYLLSTDVERMQELADSFDYIIDTDPVHHPLEPSLSLLKLDGKLIIMGVINVPLQFVSPLLMLGRKTITEAFIGSMKETQEMLHFCKEKGVRSTIEVVKMDYINTAMERLAKNDVRYRFVVDVAGSNLHNE

SEQ ID NO: 11296 - protein, 426 aa, Triticum aestivum
  unsure (1)..(426): unsure at all Xaa locations
AMAMDESPQLFLCPISMELMEDPVTVSTGVTYDRRSIERWFFKYGKTTCPATMQRVASLDLTPNHTLKRVIASWQDRASTSSSPSSPAGAFKPMARERLPSVLARHXGHALQGHRAQGPEAFKVTALKSMRSCMAGDVAMQIIFVASGGVEAVGRVMAQALAESGAGGDFSAFTVCEEAAAVLAALPLSDKASVGLVLAPECLRPVMALLQRGSAEARLHAMDILTKISSAGAGDHWTAGIDVDDVLKSLLELLSDEVSARLSSRALDVLLDVVERSPSGRAKAVEVGAVHVLVELLVVDADDRHVAERILLLLKRLCKCPEGRLAFAEHDLSVAAVARTMLRVSDLATQLAVKVLWLVSMVAQSEKVLEDMVLTGAVAKLLGLLHVESAPSTKQKTVRMVRIHGVFWRQYPCFPTDLKDYLRLLD

SEQ ID NO: 11297 - protein, 256 aa, Pantoea endophytica
  unsure (1)..(256): unsure at all Xaa locations
GSAGGIGQALALLLKTQLPSGSELSLYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILXXLSQIPGVSFTEQEVADLTKRIQNAGTEVVEAKAGGGSATLSMGQAAARFGLSLVRALQGEKGVVECAYVEGDGQYAR

SEQ ID NO: 11298 - protein, 485 aa, Grateloupia stipitata
NSVERTRIKNERYESGVIPYAKMGYWDPDYVVKDTDVLALFRVTPQPGVDPVEASAAVAGESSTATWTVVWTDLLTACDLYRAKAYKVDSVPNSTEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYAMEGVNRSIAATGEIKGHYMNITAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALEAIVIARNEGRDYVGEGPQILQDAAKTCGPLQTALDLWKDISFNYTSTDTADFVETPTANV

SEQ ID NO: 11299 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGIKNKMDPGEAMDINLFKLTLDEIREKGIKQMPHTLRRSLEEMLADKQYLKEDQ

SEQ ID NO: 11300 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPRMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMQAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 11301 - protein, 495 aa, Catharanthus roseus
FFIFLFFVFLLINGRRKSTRTKTINLPPGPWKLPILGNLHNMMMGSVPHRLLRDLAKKHGDLMLLKLGEFNAIVVSSPRMAKEVLKTHDLSFLNRPIIQAPKILCYDNSDLVFSQYGDSWREMRKIFVLELLSTKRVRSFQPIRQDEGSRLVSLIKESVGKSIDLSEKINSYTTSMVARAAFGKVNDAGVTFLKLVKEASEVAGGFDPADIFPSYKFLNVFFNSRSKLLKIHGKTDMILEEMIDEHIKNHEMGKKANGENGKEDVIDILLSIKDSGELQFPFQMNNVKALIFDMFAAGTETSSSTVEWAMSELIRNPDVMAKAQNEVRQVLKGKQIVDESVLQELEYLKLIVKEVLRLHPSSPLLIPRECGEDCQIDGYDIPVKTRVFVNIWAIARDDKYWKDPESFIPERFENTCFDFTGNNFEYLPFGSGRRMCPGMTFGLANVDLVLALLLYHFNWKLPPGVNDIDMTERVGLGATKKHSLVLIPTLYDPSF

SEQ ID NO: 11302 - protein, 284 aa, Streptococcus agalactiae NEM316
MKGIILAGGSGTRLYPLTRAASKQLMPIYDKPMIYYPLSVLMLAGIKEILIISTPQDLPRFEDMLGDGSELGISLSYAEQPSPDGLAQAFIIGEEFIGDDHVALVLGDNIYHGPGLSAMLQRAASKESGATVFGYQVKDPERFGVVEFDTDMNAISIEEKPAQPKSNYAVTGLYFYDNDVVEIAKNIKPSPRGELEITDVNKAYLDRGDLSVELMGRGFAWLDTGTHESLLEAAQYIETVQRMQNVQVANLEEIAYRMGYITREQVLELAHHLRKMSMVNTYFV

SEQ ID NO: 11303 - protein, 540 aa, Glycine max
MATRRLSLLLSRSLSSTSFQAASLLHSLGRNSGKWGNFNRFSTAAAVEDLITPQVPITYTKHLINGQFVDAASGKTFPTYDPRTGEVIAQVAEGDAEDINRAVSAARKAFDEGPWPKLTAYERCKIILRFADLVEKHGDELAALETWNNGKPYEQSATAELPTFVRLFRYYAGWADKIHGLTVPADGNYHVETLHEPIGVAGQIIPWNFPLLMFAWKVGPALACGNTVILKTAEQTPLTALYVAKLFHEAGLPPGVLNVVSGYGPTAGAALASHMDVDKLAFTGSTETGKVVLGLAAQSNLKPVTLELGGKSPFIVCEDADVDQAVELAHFALFFNQGQCCCAGSRTFVHEHIYDEFLEKAKARALKRVVGDPFKKGVEQGPQIDVEQFQKVLRYIKSGIESKATLECGGDQIGSKGFFVQPTVFSNVQDDMLIAKDEIFGPVQTILKFKDIDEVIRRSNATHYGLAAGVFTKNVHTANTLMRALRVGTVWINCFDVFDAAIPFGGYKMSGIGREKGIYSLNNYLQVKAVVSPVKKPAWL

SEQ ID NO: 11304 - protein, 175 aa, Oryza sativa
MAPTVMASSATSVAPFQGLKSTAGLPVSRRSTNSGFGNVSNGGRIKCMQVWPIEGIKKFETLWYLPPLTVEDLLKQIEYLLRSKWVPCLEFSKVGFVSRENHRSPGYYDGRYWTMWKLPMFGCTDATQVLKELEEAKKAYPDAFVRIIGFDNVRQVQLISFIAYKPPGCEESGGN

SEQ ID NO: 11305 - protein, 237 aa, Lycopodium annotinum
MGRGKIEIKRIENATCRQVTFSKRRSGLLKKAHELSVLCDAQVAVIIFSSTGKLFQFASTRMKEILERYERNSDPLQIDAVIPRDLEYWSREAAKAKDELDRCHQKNRHMLGEDLSALNLNELEELEQQLDSGLRRVRCRKDQVLRDRIEELTKQESFLREENRMLRSKIAVPKESTEPILDEMNMETREPPSMAIVEEELSLKLNSKTWPDIHFSLQLGQYQPPRTETPTANHRPN

SEQ ID NO: 11306 - protein, 368 aa, Neurospora crassa
MATHNIVVFGGDHCGPEVVLEAIKVLKAIETNSPSACKFNLQNHLLGGASIDKHNDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIVRIARLAGFLALAKNSPAKVWSLDKANVLATSRLWRKTVTDVISKECPQLQLEHQLIDSAAMLLVKNPRALNGVVITSNLFGDIISDEASVIPGSIGLLPSASWGGIPDGKVKCNGIYEPIHGSAPDISGKGIVNPVCTILSVAMMLRYSLNLPKEADAVEAAVKAAIDNGTKTKDLGGNATTSDMGNAVVAELEKILKA

SEQ ID NO: 11307 - protein, 279 aa, Oryza sativa
MEMTRSLTLAPLPATLRPASAACRRRRRRRGLPFGALFSPSPPSNQQQQEMHIRALQPRQDWVGEWVRSNDTLVRGLPILVGGASLLAVLLNRAVSGIAAVADASSSQSRADILTLALSVTDILAGLVWLSIRPKSISPVVPRGVECKRVGTGVLDSALRELLWTWDSLTTATCCKSLVVVYGEDGNAVMVDAQKFMQGSLYRSAMESKKQSYLANLALYPGRTELPFLPANTQALILQPIGDKGIAVIGGDTIRGFTNLDQAWIAMIADKLDATLSKS

SEQ ID NO: 11308 - protein, 477 aa, Clostridium perfringens str. 13
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKIVNKAIMDSEIPDEILIVMIKRDNKVVIPKGFTIIKPNDTLVLTSKNNEIMNSFLDEIR

SEQ ID NO: 11309 - protein, 427 aa, Saccharomyces cerevisiae
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 11310 - protein, 302 aa, Thermoanaerobacter tengcongensis
MKIKKAIIPAAGLGTRFLPATKAQPKEMLPIVDKPTIQYIVEEAVQSGIEDILIITGRNKRAIEDHFDKSVELELELKKKNQESLLSLVEDISNMVNIHYIRQKEPKGLGHAIYCAKSFVGNEPFAVLLGDDVVDAEVPVLKQMIEQFERYNCTIIGVQEVPEEDVHKYGIVSGTFIEDRLYKVNDLIEKPRREEAPSNIAILGRYIITPRIFEILEHTPPGRGGEIQLTDALKTLLNYEAIYAYNFIGKRYDVGDKLGYLMATVEYALKREDLREPFKRYLITIVQDLLGMEEAAVTERDV

SEQ ID NO: 11311 - protein, 372 aa, Sinapis alba
MGSSHEEGKSTTQSDKPAQVQAPPPPPPPIQEQSNVHVYHHDWAAMQAYYGTRVAIPPQYYNSNGHAAPPPPYIWGSPSPMMAPYGTPYPPFCPPGGIYAHPGVQMGTQPQGPTSQATPVVTTPLNLEAPANSAGNTDQGFMKKLKEFDGLAMSISNNKAGSAEHSSEPRNSQSSENNDDSSNGSDGNTTGGEQSRKKRSREGSPTNDGKPSSQIVPLLRDENEKQAVTMGTPVMPTAMDFPQPCHGAPREVWNEKEVKREKRKQSNRESARRSRLRKQAETEELSVKVDALVAENMTLRSKLGQLNDESEKLRLENEALLAQLKATQTQATGKTENLISGVDKNNSVSGSSKNVEQQLLNVSLRTDSVAAS

SEQ ID NO: 11312 - protein, 524 aa, Zea mays
MTWNRSAADGGGSSAGTTAGDDTGLARLRELGYKQELKRDLSVLSNFAFSFSIISVLTGITTLYNTGLNFGGPATMTFGWFVAGAFTMAVGASMAEICSSFPTSGGLYYWSARLSGKRWAPFASWITGWFNVVGQWAVTTSVDYSLAQLIQVIILLATGGKNGGGYLASKYMVIGFHAAILLSHAVINSLPITFLSFFGQFAAAWNMLGVFVLMVAVPTVATERASAEFVFTHFNTDNGAGIRSNLYIFVLGLLMSQYTLTGYDASAHMTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPSLGSLVAFQAMVSIATIGLYISYALPILFRVTLARKYFVPGPFNLGRYGVLVGWVAVLWVATITVLFSLPVTYPVTKDTLNYTPVAVGGLLFLVLASWLLSARHWFKGPVTNLDG

SEQ ID NO: 11313 - protein, 818 aa, Agrobacterium tumefaciens
MIDDILDKMTLEEQVSLLSGADFWTTVAIERLGVPKIKVTDGPNGARGGGSLVGGVKSACFPVAIALGATWDPELIERAGVALGGQAKSKGASVLLAPTVNIHRSGLNGRNFECYSEDPALTAACAVAYINGVQSQGVAATIKHFVANESEIERQTMSSDVDERTLREIYLPPFEEAVKKAGVKAVMSSYNKLNGTYTSENPWLLTKVLREEWGFDGVVMSDWFGSHSTAETINAGLDLEMPGPWRDRGEKLVAAVREGKVKAETVRASARRILLLLERVGAFEKAPDLAEHALDLPEDRALIRQLGAEGAVLLKNDGVLPLAKSSFDQIAVIGPNAASARVMGGGSARIAAHYTVSPLEGIRAALSNANSLRHAVGCNNNRLIDVFSGEMTVEYFKGRGFESRPVHVETVEKGEFFWFDLPSGDLDLADFSARMTATFVPQETGEHIFGMTNAGLARLFVDGELVVDGYDGWTKGENFFGTANSEQRRAVTLGAARRYRVVVEYEAPKASLDGINICALRFGVEKPLGDAGIAEAVETARKSDIVLLLVGREGEWDTEGLDLPDMRLPGRQEELIEAVAETNPNVVVVLQTGGPIEMPWLGKVRAVLQMWYPGQELGNALADVLFGDVEPAGRLPQTFPKALTDNSAITDDPSIYPGQDGHVRYAEGIFVGYRHHDTREIEPLFPFGFGLGYTRFTWGAPQLSGTEMGADGLTVTVDVTNIGDRAGSDVVQLYVHSPNARVERPFKELRAFAKLKLAPGATGTAVLKIAPRDLAYFDVEAGRFRADAGKYELIVAASAIDIRASVSIHLPVDHVMEP

SEQ ID NO: 11314 - protein, 79 aa, Triticum aestivum
  unsure (1)..(79): unsure at all Xaa locations
ILRLSSSCLCHHPDLXMCXKXVXXXIXRLXDKWXGKCPVXDSYVXPTILVXIXDEWSFGNYQXKCVVCXGEGISXXFYC

SEQ ID NO: 11315 - protein, 175 aa, Oryza sativa
GPTSPRPCWPASAAAPPRSSRPTGTDGGGSGRLRRMRGYRHSPVGLEGEIMMFQTRVLLGGMSMYDRYQDWRLDVDNMTYEELLELGDKIGYVNTGLREDEIVRNLRKVKHPAFDSSFRYSTEMEKKCSICQEEFEANEEMGRLDCGHSYHVYCIKQWLSQKNVCPVCKTAVTKT

SEQ ID NO: 11316 - protein, 315 aa, Coleochaete scutata
  unsure (1)..(315): unsure at all Xaa locations
KVGINGFGRIGRLVARVALGRDDVELVAINDPFISTEYMVYMFKYDSVHGRWGGNVELKDAKTLLFNGKPVNVYDKRDAAEIPWSEMGAEYVVESTGVYTDMDKAAAHLKGGAKRVVISAPSKDAPMFVMGVNHEKYKGEAIVSNASCTTNCLAPLAKVVNDRFGILEGLMTTVHSITATQKTVDGPSSKDWRGGRGAGFNIIPSSTGAAKAVGKVLPELNGKLTGMAFRVPTADVSVVDLTVRLEKAATYDEIKAALKEASEGAMKGILGYTEDDVVSTDFITDERSXVFDAKAGIALNNKFVKLVSWYDNELG

SEQ ID NO: 11317 - protein, 68 aa, Zea mays
  unsure (1)..(68): unsure at all Xaa locations
MDPYKHRPSSGSNYSFWTTKCGAPVWNNNYALTVXHXGPILLEDYHILQKLAQFDRERIPERVVHARR

SEQ ID NO: 11318 - protein, 713 aa, Glycine max
  unsure (1)..(713): unsure at all Xaa locations
PEKPSSVFTKRSSQTATLQHKKPASSVDAEIVGGSTISSQAMLKQEVSTASSKGTTLKEGDRVKFVGNFPSAVSSLPNYPSRGPSYGSRGKVLLAFEDNRSSKIGVRFDKSIPDGNDLGGLCEEDRGFFCSANHLLRVDGSGGDDADKVAISDIFAASANQSKSGPLVLFIKDIEKAMVGNYEVLKNKFESLPPNVVVIGSHTLLDNRKEKTQPGGLLFTKFGSNQTALLDLAFPDNFGRLEPNRXSSKTPKVMKQLGRLFPNKVTIQLPQDEALLSDWKQQLERDIETMKAQSNIVSVCTVLNRIGLDCPDLETLCINDQTLTTESVEKIIGWAISYHFMHSSEASIKDSKLVISAKSINYGLNILQGIQNENKNLKKSLKDVVTENEFEKKLLADVIPPTDIGVTFDDIGALENVKDTLKELVMLPLQRPELFCKGQLAKPCKGILLFGPPGTGKTMLAKAVATEAGANFINISMSSITSKWFGEGEKYXVKAVFSLASKIAPSVIFVDEVDSMLGRRENPGEHEAMRKMKNEFMVNWDGLRTKDKERILVLAATNRPFDLDEAAVIRRLSRRLMVNLPDAPNREKILRVILVKEDLAPDVDFEAIANMTDGYSGSDLKNLCVTAAHCPIREILEKEKKERSLALSESQPLPGLCGSGDIRPLKMEDFIYAHEQVCVSVSSESTNMNELLQWNDLYGEGGSRKMRSLSYFM

SEQ ID NO: 11319 - protein, 185 aa, Azotobacter vinelandii
MILEGSMSHKVEAAFVPLNIAVLTVSDTRTLGTDTSGQLLVERLSAAGHKLAARLLLKDDLYHIRAVVAAWIADKDVQVVLITGGTGFTGRDSTPEAVTCLLDKQVDGFGELFRHISMAEIGTSTVQSRALAGLANGTLVCCLPGSTGACATAWDGILAEQLDARHRPCSFVPHLKPVPSCGARG

SEQ ID NO: 11320 - protein, 315 aa, Zea mays
SYYASPFSFRCPPTSATRLPPRQWPREPASAPPLVSSALRQQRRPWATSTVSSVASARRSFMSVLVGVHTMPGKHSRAPPHPHGGTRLQQQTPALRAAARVDVRFVLCARPMPPEAPRVRCARGARLRRRAWSSTAPRTRRRGRRTRTSRACPPCSAPAPVAAAGRTTYVMKVDDDTFLQLDALADTLRSAPREDMYCGVGLPFHDRQFPPFMLGMGYLLSWDLVEWIATSDMVRREAMGVEDLTTGKWLNMGHKAKNRVNIFPRMYDYKSAKGEDFLENTIGVHQLKQDLRWAHTLEHFNVTRLEPSNMLLHNF

SEQ ID NO: 11321 - protein, 449 aa, Pseudomonas fluorescens PfO-1
MVAPGTEGLRVDSTGLRSNQARCSIQTMEFSMGYKKIQVPAVGDKITVNADHSLNVPDNPIIPFIEGDGIGVDVSPVMIKVVDAAVEKAYGGKRKISWMEVYAGEKATQVYDQDTWLPQETLDAVKDYVVSIKGPLTTPVGGGIRSLNVALRQQLDLYVCLRPVVWFEGVPSPVKKPGDVDMVIFRENSEDIYAGIEWKAGSPEATKVIKFLKEEMGVTKIRFDQDCGIGIKPVSKEGTKRLVRKALQYVVDNDRKSLTIVHKGNIMKFTEGAFKDWGYEVAKEEFGAELLDGGPWMKFKNPKTGREVVVKDAIADAMLQQILLRPAEYDVIATLNLNGDYLSDALAAEVGGIGIAPGANLSDTVAMFEATHGTAPKYAGKDQVNPGSVILSAEMMLRHLGWTEAADLIIKGTNGAIKAKTVTYDFERLMEGATLVSSSGFGEALIKHM

SEQ ID NO: 11322 - protein, 327 aa, Thauera selenatis
MSQRQLAYVFDLNKCIGCHTCTMACKQLWTNRDGREYMYWNNVESRPGKGYPKNWEQKGGGFDKDGKLKTNGIIPIRADYGGTWNYNLLETLVEGKSNQVVPDEKPTWGPNWDEDEGKGEFPNNHYFYLPRICNHCSNPACLAACPTKAIYKREEDGLVVVDQSRCKGYRYCVKACPYGKMYFNLQKGTSEKCIGCYPRVEKGEAPACVKQCSGRIRFWGYRDDKDGPIYKLVDQWKVALPLHAEYGTEPNVFYVPPMNTTPPPFEEDGRLGDKPRIPIEDLEALFGPGVKQALATLGGEMAKRRKAQASELTDILIGYTNKDRYGI

SEQ ID NO: 11323 - protein, 488 aa, Chordaria sp. Kamchatka_5
MPEDVQNRTRIKSERYESGVIPYAKMGYWDADYNVKATDILALFRITPQPGVDPVEAAAAVAGESSTATWTVVWTDLLTACDIYRAKAYRVDPVPGTSYQFFAYIAYECDLFEEGSLANLTASIIGNVFGFKAVKALRLEDMRIPYAYLKTFQGPATGIVVERERLDKFGRPLLGATVKPKLGLCGKNYGRVVYEGLTGGLDFLKDDENINSQPFMRWKERFLYCMEGVNRAAAATGEIKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCGPVASGGIHCGQMHQLLYYLGDDVVLQFGGGTIGHPDGIQLGATANRVALESMVLARNEGRDYVGEGPEILRRAATTCGPLKAALDLWKDITFDYTSTDTPDFVEVATESR

SEQ ID NO: 11324 - protein, 306 aa, Schizosaccharomyces pombe
KMATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAG

SEQ ID NO: 11325 - protein, 477 aa, Solanum tuberosum
MVTATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 11326 - protein, 305 aa, Chlamydophila pneumoniae AR39
MHMSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 11327 - protein, 365 aa, Yersinia pestis CO92
MNMTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLTLLLRFSLGKDDAADAIERAINQALEQGYRTADLAGDGHAIGTHEMGDIIAKFVVEGV

SEQ ID NO: 11328 - protein, 109 aa, Zea mays
  unsure (1)..(109): unsure at all Xaa locations
LLRSWHLQEVDGVKVLQLETAAGAAIRFFDKAIGINVPRSRFLPVKATSDLLLGQSDLTPLVNGFVIRNPSRTNPANPSIELGPEFKKVANFLAXVQVPFPSHKLSARL

SEQ ID NO: 11329 - protein, 246 aa, Silene latifolia
MGRGRVQLKMIENKINRQVTFSKRRSGIIKKAHEISVLCDAEVALIIFSHRGKLFDFASDSCMEKILERYERYCYAEKQLASNDPDAQVNWTFDYAKLKAKLDLLQRNHRQYLGQDLDALNLKELQSLEQQLDVGLKHIRSKKNQLMHDSISELQKKERSMEEQNKMLTKKIKEKGKAATTETQQMQWQQQQQNHQDVATSSDYLIHPPVPLNMSNSYEKEQGGEGSRNDLNLTLESNCWAHHSLF

SEQ ID NO: 11330 - protein, 472 aa, Novosphingobium aromaticivorans
MADATRFYIGGEWVAPSTSVTTDIVNPANRSVVGQVALGGPADAEAAIAAARAAFPAWSATTREHRLAVLERINAALIARADEIGDAIMAEMGAPLGLARGAQAGSGPQHFEETIRVLKDYAFETPLGTTLLQREAIGVCVLITPWNWPMNQIATKVAPALAAGCTMILKPSEVAPLDAAILAEIIDEAGLPDGVFNLVHGTGPGIGDALTGHPDVDMVSFTGSTRAGIAIAANAAPTIKRVALELGGKSANILLPDADLAKAVPASVRGCMLNTGQSCNAPTRLLVPRTTLSRVEHLAREAAEAIVVGMPTDNPHMGPVANEAQYRRVIALIEQACHEGTQLLCGGVEPPKSLEHGLFVAPTIFTDVAPDATIAREEVFGPVLAIIPYETVDEAIEIANDSPYGLSGYVWGDPDAARNVARRMRTGMVHVNGASLDSAAPFGGYRMSGNGREWGVWGLEEFLEVKSIYGGA

SEQ ID NO: 11331 - protein, 551 aa, Zea mays
  unsure (1)..(551): unsure at all Xaa locations
FGTRTSWGKFWLSVLGVFEWSGNNPVPPEVWLLPYLLPFHPGRMWCHCRMVYLPMCYIYGKRFVGLITPLVLELRKELFKDPYSKIDWDKARNLCAKEDLYYPHPFVQDVLWATLHKFVEPVMMSWPGSKLREKALETAMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDNCISKAANFIESIQKSDGSWYGSXWAVCFRTALCFGVKGLIAAGRTFESSPAIRKXCSFLLSKELPSGGWGESYLSSQDQVYTNLKGNRAHAANTGWAMLALIDAGQAQRDPAPLHRAARVLINLQSEDGEFPQQEIIGVFNKNCMISYSQYRNTFPIWALGEYRCRVLGAAGKR

SEQ ID NO: 11332 - protein, 368 aa, Triticum aestivum
MIFLTTFYAWTMWRRSRRISHGKAARRPDTTTTKGITLVPILSKFNTVKMSKKGLVAMIEYPSLEAATGKFSESNVLGVGGFGCVYKAAFDGGATAAVKRLEGGGPDCEKEFENELDLLGRIRHPNIVSLLGFCVHGGNHYIVYELMEKGSLETQLHGPSHGSAMSWHVRMKIALDTARGLEYLHEHCNPSVIHRDLKSSNILLDSDINAKIADFGLAVTSGNLDKGNLKISGTLGYVAPEYLLDGKLTEKSDVYAFGVVLLELLMGRKPVEKMSPSQCQSIVSWAMPQLTDRSKLPNIIDPVIKDTMDPKHLYQVAAVAVLCVQPEPSYRPLITDVLHSLVPLVPADLGGTLRVTEPHSPHQMYHPS

SEQ ID NO: 11333 - protein, 330 aa, Helicobacter pylori J99
MPIKIAINGTGRIGLCAIRVASQRKDVEIVAINSTAELETLLHLIRHDSVHGHFEAKLNANRTLNIGHSKNILVLSERDINKLDFSVANAEIIIECTGKFNSLEASSAHLKNSVKKVIISAPAQNAPTFVYGVNHTNYHNESVISNASCTTNATAPLLKILDEAFKVENALLTTIHSYTNDQNLLDTKHKDIRRARAASLNLIPTSTGVSKAISLVLPHLGPKITGLAIRVPTPNVSLVDLSLNFKKVVSKASVQHALKDASKHAFKGIVSVDEERLVSSDFISSPFSAIVIDDQIMTIGEKNAKVLAWYDNEMGYSERLIDMAQYIAQN

SEQ ID NO: 11334 - protein, 590 aa, Pseudomonas aeruginosa PAO1
MSSTVADQLLERLSQWGVKRVFGYPGDGINGIMGAMGRRAEAFDYIRVRHEEMAAFMAGAHAKFTGEVGVCLATSGPGAIHLLNGLYDARMDHQPVLAIVGQQAATALGSDYQQEVDLQSLFKDVSAYVETVVSPAQLLHVLDRALRVAVGERQVATVIVPNDVQQMAAPKRQPHEHGHVMSAVGFVQPRPYARDADLEAAAAILNRGRRVAILAGAGALGAHRQLEAVAERLAAGVAKALLGKAAVSDDLPYVTGSIGLLGTRASSMLMEHCDTLLIVGSTFPYSEFLPKAGQARAVQIDLYPRNIGIRYPIDQALLGDAGETLERLLPLLEQKKHGAWRRRVERAVTASREEARRQAEEPADPINPQRVFRSLSEQLPDDAILCGDSGSHTNWYARDIRMRPGMLGSLSGKLATMGSGVPYAIAAKLAYPQRPVVAMVGDGAMQMNGNAELVTVQQYWQRWDSPTFIVLVLNNGDLNQVTWEQRALAGDPEFSPAQEVIDFPYARYADMLGFKGIRVDRPEDIDAAWAEAFAADRPVLLEVVTDPNVPPLPPHISFEQAKHLLGAMLQDDPKRWGVIRQSARQVLARH

SEQ ID NO: 11335 - protein, 131 aa, Flaveria palmeri
SNGGRVQCMKVWPPVGKKKYETLSYLPELTEAQLAKEVDYLHRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 11336 - protein, 313 aa, Xanthomonas campestris pv. campestris str. ATCC 33913
MELGMVGLGRMGANMAERLVRGGHRVHGFDLGAAARTSAQSKGIQTTDALVTLVSALPSPRVVWLMVPAGKIVDDTLAQLLPLLQAGDIVIDGGNSYYKDSQRRAAQLQSSGIAFVDCGTSGGVWGLQEGYSLMVGGDEAAVTTLHPVLATLAPAPDKGWGRVGPSGAGHFTKMVHNGIEYGMMQAYAEGFALLQHKTDFALDLHQVAEIWRDGSVVRSWLLDLTADALAHNPTMGGIAPYVADSGEGRWTVAEAIDLEVSAPVITLSLMERLRSRDKDSFTDKLLAAMRNQFGGHAVLTTTPTPTPIGSKDA

SEQ ID NO: 11337 - protein, 418 aa, Desulfitobacterium hafniense
MSRIKNLREEALEFHKVQPGKLEVRVTVPAQDRDDLTLAYSPGVAEPVKEIAADLENLDIYTNHANYVSIVSNGTAILGLGDLGAAASMPVMEGKSLLFKAFGDVDAFPLCVNTTDVDKIVEIVELTSPTFGGVNLEDIKAPECFEIEEKLKARGIFKGPIFHDDQHGTAVVTLAGLVNALKVVGKKIEDIKVVANGAGAAGIAIIKLLMSMGLKNVIMCDTKGAIYEGRTVGMNPWKEEIAKATNPEKFSGDLAGALVGADAFIGISAANVLNEDMIRSMAKDPIVFCQANPIPEIWPIERAFEAGAKVISTGRSDVINQINNVLAFPGMFRGAIDVRATDINDAMKVAAAYAIAGIVKDEELSADYIIPSTFNPEVAPAVAAAVAKAAIDSGIARRPMDPQEVADGLKKRLANQYK

SEQ ID NO: 11338 - protein, 254 aa, Zea mays
  unsure (1)..(254): unsure at all Xaa locations
MARATNAHHHRLRLLLCLSLAAAAWAHGGGGDSDADADADGGAAARPDLRARSLVEAKLWCLAVVFVGTLLGGVSPYFMRWNEAFLALGTQFAGGVFLGTALMHFLSDANETFGDLLPDSGYPWAFMLACAGYVVTMLADVAISYVVSRSQGRSTGTAATGGSDAGLEEGKMRTTNGTRSEPTPADAHGSDXHSAASILRNASTIGDSVLLIVALCFHSVFEGIAIGIAGKAKPDRDRDIWMRCFVPFQLADDA

SEQ ID NO: 11339 - protein, 191 aa, Lactobacillus plantarum WCFS1
MELLIDNYDSFTYNLYQLIGRLTPDVRVIKNDDLTVAAIKALQPDHIILSPGPGTPAHTGVSPQVVQQLAGQVPILGICMGLEVMVTAFGGSLQGAQHLVHGQATLMHVQPSSLFKDCPMQFMAARYHSLVADAGRLPVNFRIIGTSDDQEIMAVEDVGRQLYGVQFHPESIMTPAAVGEQLIRNFLALKH

SEQ ID NO: 11340 - protein, 518 aa, Colletotrichum lagenarium
MPTLGFLKKKRTREGNQDPQGSLPTSPVTPTSSKPFDSSISTTLSSLSNNSQATSQPSGPGQKQQEDPASSEAAKNQQMYPVTVHPAPNQQHYNQQGEPQQNLPSISNLINPTQHDASSNGHNYLAQPTQTSQPNPSPGTDPTRLQQQQAQSMLHPPTQPQQQQQQQQQQQQQQQTQQLQQQKNGMPQQAPDQQVRQTKGKYTLQDFDILRTLGTGSFGRVHLVQSKHNQRFYAVKVLKKAQVVKMKQVEHTNDERRMLGEVKHPFLITLWGTFQDSKNLYMVMDFVEGGELFSLLRKSGRFPNPVAKFYAAEVTLALEYLHSRDIIYRDLKPENLLLDRHGHLKITDFGFAKRVPDKTWTLCGTPDYLAPEVVSNKGYNKSVDWWSLGILIYEMLCGYTPFWDSGSPMKIYENILKGKVKYPAYINPDAQDMLSKLITADLTKRLGNLYGGPNDVKTHPWFQEVTWDRLARKDIDAPYTPPVKAGAGDASQFDRYPEDPERYGSSGHDEYGHLFTDF

SEQ ID NO: 11341 - protein, 485 aa, Nocardioides sp.
MTTPRKFDEYRWNVLVDGVPLNVESRYPISDPSTGRYLTQVPDCAEADVDRAVQASRQAQAEWGALPPRARAAKLRELITLLREHREEFAMLDAIDGGFPISMMRNDVDAALELMDIFADMALDLGGKTIPVSTNLHFTTHEPFGVVARIGAFNHPFFFAASKVAAPLMAGNSVILKAPDQTPLSSLRLAEVAAEVLPQNLLITISGRGRVAGRAIVRHPQIKRIGFIGSTDTGRSIQRDAAEVAVKHISLELGGKNAQIVFADADLEQAALGAVNGMNFTWTAGQSCGSTSRLLVHESVADQVIARVVELVSAIAVGPPLDENAQMGPLVSQAQYDKSVHAIGEGIREGAKVVAGGGRPEGVGEGGWYLAPTVLADVRPGSFIEQNEIFGPVLSVIIFATDDEAVAIANGVEYGLTASVWTSDITRAHLIARRVEAGYVLVNGGSRHYWGLPFGGVKSSGVGSEESMEELISYTETKTTTVVLG

SEQ ID NO: 11342 - protein, 90 aa, Nostoc sp. PCC 7120
MSLPPANTPLYSHPLPQIEQWLKEQGCQQDDTQLHCWRLQCPSWQAELWLDVEQIVVRYVQAGENGQDIQRAFKYSLSREDIEQAVFSGP

SEQ ID NO: 11343 - protein, 308 aa, Enterococcus faecium
MEVKELEQLIGKNFHYYQTGQVADYIPALAEVDPKQLGMAIYDLDTKQLIEGGDADVRFAIESMSKVPVLLLAIKDNGIEKVFQTINTEPTGFAFNSIMNMEINHRKHPMNPFVNAGAIATTSLIAGKDADEKFERILSFMKEICDDPNITLNEEIYHSESRTGDINRSLAYYMKGNQMIEGDVPEILDAYFRQCSLNVTATGIAKLAAVLANKGIAPWNGKQIITEESATIVKSIMTTAGLYDESGEFSVHVGVPAKSGVGGGLMAAVPNRYGIGVFSPALDPFGNSAAGIQLLKDVVKELDADIFE

SEQ ID NO: 11344 - protein, 506 aa, Acinetobacter calcoaceticus
MNDDTKKCPFSQLTTDFGAPVVDNQNSMTAGARGPLLAQDLWLNEKLANFVREVIPERRMHAKGSGAFGTFTVTHDITQYTRAKIFSEIGKKTEMFARFTTVAGERGAADAERDIRGFALKFYTEEGNWDMVGNNTPVFFLRDPRKFPDLNKAVKRDPKTNLRSATNNWDFWTLLPEALHQVTIVMSDRGIPASYRHMHGFSSHTYSFINSVNERFWVKFHFRTQQGIKNLTDAEAGELVGHDRESHQRDLFDAIERKDFPKWTLYVQVMPEQDAEKVPYHPFDLTKVWPHGDYPLIEVGEFELNRNPENFFLDVEQSAFAPSNLVPGISASPDRMLQARLFNYADAQRYRLGVNYQQIPVNAARCPVHSNHRDGQGRIDANYGGLPHYEPNSFGQWQEQPQYKEPPLKINGDADFWNYREDDNDYFSQPRALFELMTPEQQQALFDNTERAMGDALDFIKYRHIRNCYACHPAYGEGVAKALGLTVENAQAARETDPARGLPSFI

SEQ ID NO: 11345 - protein, 212 aa, Triticum monococcum
MSMSCGLCGASDCPHHMISPVLQHQEQHWLREYQFFTQGHHHHHHGAAADYPPPPPPSANCHHCRSWTTPFHETAAAGNSSRLTLEVDAGGQNMAHLLQPPARPRTTIVPFCGAAFTSTISNATIMTIDTEMMVGAAHNLTMQEREAKVMRYREKRKRRCYDKQIRYESRKAYAELRPRVNGCFVKVPEAAASSSPPASPYDPSKLHLGWFQ

SEQ ID NO: 11346 - protein, 435 aa, Rhizobium leguminosarum bv. phaseoli
MTLDLAAFARDKSIKYFMISYTDLFGGQRAKLVPAEAIADMQKDGAGFAGFATWLDLTPAHPDLFAVPDASSVIQLPWKKDVAWVAADCVMDDRPVEQAPRVVLKRLVAEAAKEGLRVKTGVEPEFFLISADGSVISDQFDTAEKPCYDQQAVMRRYDVIAEICDYMLELGWKPYQNDHEDANGQFEMNWEYDDVLKTADKHSFFKFMVKSVAEKHGLRATFMPKPFKGLTGNGCHAHISVWDVDGRVNAFADKEMAFGLSAQGKTFLGGIMKHAPALAAITNPTVNSYKRINAPRTTSGATWSPNTVTWTGNNRTHMVRVPGPGRFELRLPDGAVNPYLLQAIIIAAGLEGIRSQADPGQHYDIDMYAEGHLVKDAPRLPLNLLDALRAFDADEGLKAAIGAEFSSAYLKLKHLEWNAYCSHFTQWERDSTLDI

SEQ ID NO: 11347 - protein, 164 aa, Oryza sativa (indica cultivar-group)
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAETAEEIAAAARVREARQRAAAAASRMPPAPEDPELDQFMEDYCKLLVECKEELSRPLQEAEEFL

SEQ ID NO: 11348 - protein, 483 aa, Agrobacterium tumefaciens str. C58
MQTVNLFIGGDHCAAANGKRFERNNPITGDAVTSAAAASVEDATNAADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 11349 - protein, 292 aa, Vibrio cholerae
MKGIILAGGSGTRLYPITRGVSKQLLPIYDKPMIYYPLSTLMLAGIRDVLIITTPEDNESFKRLLGDGRDFGIHLQYAIQPSPDGLAQAFLIGEEFIGNDSVCLVLGDNIFYGQSFSKTLRHAASREHGATVFGYQVKDPERFGVVEFDEQMRAISIEEKPLKPKSNYAVTGLYFYDSRVVELAKQVKPSARGELEITTLNEMYLNDGSLNVELLGRGFAWLDTGTHESLHEASSFVETVQHIQGLKIACLEEIAWRNGWLTSEQLLECAKPMLKNDYGQYLERLVKEERHG

SEQ ID NO: 11350 - protein, 231 aa, Synechococcus sp. PCC 7942
MYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 11351 - protein, 177 aa, Triticum aestivum
  unsure (1)..(177): unsure at all Xaa locations
MAPTVMASSATSVAPFQGLKSTAGPPXSARRSNGASLGSVSNGGRIRCMQVWPIEGIKKFETLSYLXPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 11352 - protein, 271 aa, ASPERGILLUS NIDULANS FGSC A4
MASAMAKRLEGKTIVITGASSGIGRSTAREFARTAPKDLKLIVTARRIDALEELAKEIKEEVGEGVKTLPVKLDVSNPEEVKNFVPSLPAEFQDIDILVNNAGLVKGVAQAPNIDPEDINIMFATNVTGLINLTQAVLPIFKKRSDGGRGDIINIGSIAGREPYPGGSIYCSTKAAVKSFTEALRKELISTRIRVIEIDPGQVETEFSIVRFYGDKSKANAVYANCEPLTPDDIAEVIVFAAGRRENVVIADTLIFPSHQASPGHLYKKPQ

SEQ ID NO: 11353 - protein, 350 aa, Bifidobacterium longum NCC2705
MDVSLAHFLQQVLSNPALTVTTLLTLGVIFVNGWTDAPNAIATCVTTRCMRVRSAVIMAAIFNFLGVFIMTQLNASVASTISNMVDFGGDTNAALIALCAALFSIVVYSVGASLLGIPTSESHSLIAGLSGAAIAIQGGIGGINMGEWVKVLYGLVASLLFGFAVGWLVCKAVTLICAGMDRRRTNGFFTYAQIVGAAAMSFMHGAQDGQKFIGVLFLGMAFCNGQPSVTGVMIPIWLMILCSTIMGVGTSVGGERIIKSVGQDMVKLEKYQGFSADLSSALCLLVMTVLGIPVSTTHTKTSAIMGVGAVRRLSAINFGVVRDMMLTWVFTFPGCGLISFVMAKLFMVVF

SEQ ID NO: 11354 - protein, 514 aa, Arabidopsis thaliana
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASGSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTSALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIIGWVTVTMGPLFYGLHKMNLLRISAEDEMAGMDMTRHGGFAYAYNDEDDVSTKPWGHFAGRVEPTSRSSTPTPTLTV

SEQ ID NO: 11355 - protein, 121 aa, Triticum aestivum
RHGRHLLGTTVCWFVLDIAFYSQNLFQKDIYTAVEWLPRADTMNALQEMFKISRAQTLVALCGTIPGYWFTVFLIDVVGRFAIQLGGFFFMTAFMLGLAVPYHHWTTPGNHVGFVVMYAFT

SEQ ID NO: 11356 - protein, 505 aa, Candida tropicalis
MYQLFCFLAGIIVVYKAAQYYKRRTLVTKFHCKPARISPNKSWLEYLGIASVVHADEMIRKGGLYSEIDGRFKSLDVSTFKSITLGKTTYVTKDIENIRHILSATEMNSWNLGARPIALRPFIGDGIFASEGQSWKHSRIMLRPVFAKEHVKQITSMEPYVQLLIKIIKNHEGEPLEFQTLAHLFTIDYSTDFLLGESCDSLKDFLGEESNSTLDTSLRLAFASQFNKTQQQMTIRFMLGKLAFLMYPKSFQYSIQMQKDFVDVYIDRVVGMSEEELNNHPKSYVLLYQLARQTKNRDILQDELMSILLAGRDTTASLLTFLFFELSHHPEVFNKLKEEIERHFPDVESVTFGTIQRCDYLQWCINETMRLHPSVPFNFRTAANDTVIPRGGGKSCTDPILVHKGEQVLFSFYSVNREEKYFGTNTDKFAPERWSESLRRTEFIPFSAGPRACLGQQLPRVEASYVTIRLLQTFHGLHNASKQYPPNRVVAATMRLTDGCNVCFI

SEQ ID NO: 11357 - protein, 394 aa, Zea mays
TKLHGAALPAGTPTHGPKPPGHANDPRRDRNPAHKRRRAPKHHGKQGKQSGGRGRNKRKEKKERRKKKKRGGRRKGGGEGRKRRRGGRESKREEKFFFLRVGGRVGEAFAGRAKIVHIDIDPAEIGKNKQPHVSICADVKLALQGMNTLLEGSTSKKSFDFGSWHDELDQQKREFPLGYKIFNEEIQPQYAIQVLDELTKGKAIIATGVGQHQMWAAQYYTYKRPRQWLSSAGLGAMGFGLPAAAGAAVANPGVTVVDIDGDGSFLMNIQELAMIRIENLPVKVFVLNNQHLGMVVQWEDRFYKANRAHTFLGNPENESEIYPDFVAIAKGFNIPAVRVTKKSEVHAAIKKMLEAPGPYLLDIIVPHQEHVLPMIPSGGAFKDMILDGDGRTVY

SEQ ID NO: 11358 - protein, 217 aa, Zea mays
MGASADGAMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 11359 - protein, 334 aa, Eremothecium gossypii
MVEPTLKKQRTGNSLAQLKATGTTVVADTGDFQAIAKYAPQDATTNPSLILAAARKEGYQALIDRAVEYGRSRDGSVEQQTEAAVDRLLVEFGKEILKVVPGRVSTEVDARLSFDKDATVRKALEIISLYEQQGVSKDRVLIKIASTWEGIQAARELESQHGIHVNCTLLFSFCQAVAAAEAGVTLISPFVGRILDWYKASTGKTYSGDEDPGVLSVRRIYNYFKKHDYPTIVMGASFRNLDEIKALAGVDFLTFWPASLNQLMTSADPVPQVLDPASAKAQGDDKVSYVEDEPAFRFALNDDAMATEKLAEGIRKFSEDIVTLFAMVEERIRA

SEQ ID NO: 11360 - protein, 445 aa, Escherichia coli O157:H7 EDL933 [sequence omitted]

SEQ ID NO: 11361 - protein, 177 aa, Fagus sylvatica
NFPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAMVNSKTPRKSLAFFFCPK

SEQ ID NO: 11362 - protein, 428 aa, Lactobacillus gasseri
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATACAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTESHKDRIQIVLDDFICTNPKLLNKAIHEGAGNASLIKLNQIGTVTETLETIRLSRKNGYNTMISHRSGETGDTFIADFAVAVNGGQLKSGAPARSERVEKYNRLLEIEEELGKGERLAFFPDNVDLD

SEQ ID NO: 11363 - protein, 271 aa, Agrobacterium tumefaciens
MDTAVHETTVAERIAKALRRHDVEVIFGQSLPSAVILAAEKIGITQIAYRQENMGGAMADGYARRSGKIGIVAAQNGPAAALLVAPLAEALKASVPVVALVQDVERDQTDRNAFQDLDHIGLFQSCTKWVRRVSVEERIDDYIDAAFTAASSGRAGPAVLLLPADLLRSVSTTPSRRRTNNLGHWPLDRSRPADKDLDIAAKAIANARAPVVIAGGGIHASGAAQQLRLLQDECSIPVFTTNMGKGSVDEWHPLSGGVLASLVGPKSTGST

SEQ ID NO: 11364 - protein, 356 aa, Eucalyptus saligna
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCGPCNSDQEQYCNKKIWNYNDVYTDGKPTQGGFAGEIVVGQRFVVKIPDGLESEQAAPLMCAGVTVYSPLVRFGLKQSGLRGGILGLGGVGHMGVKIAKAMGHHVTVISSSDKKRTEALEHLGRDAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 11365 - protein, 659 aa, Neurospora crassa
MAGFDQDIELSAYSHSHGLGISGNGRSGRQRSIAEASSFTLGGASPSPRTKSFADVSPGGSHGRSKSIAAASDGAGGGFHGTMSRFVDSFRRGDGTINKNLDLDDDNNTSSHGYSSHSISRGHGGTRYYDLRPGTGKINTPSSLLARELKGRHLQMIAIGGSIGTGLFVASGKTLSDGGPASVLIAYLIIGVMLFCTIQALGELAVIFPVAGSFSAFSTRFLDPSWGFAMGWNYALQWIGVLPLEVLAGAMTIGYWNKEINKAIFVTIFLVIIFVINLFGAKGYGEAEFIFAIIKVTAVVGFILLGIVINIGGTPTEGYIGGKYWEDPGAFHNGFKGLCSVFVTAAFAFAGTELVGLAAAETANPRKSLPTAIKQVFWRISLFYIVSMTLVGLLVPYNEPRLLNAQNIADASASPFVIAIESAGATVLPSVMNGVILISVISVGNSAVYGSSRTLAALAELGQAPAILAYVDRRGRPIVAILVTMAVGLLAYLGDVPSQKNIFDWLLAISGLSSILTWASTCLAHIRLRKAWAYNHRSVQDIAFKAQGGVIGSWIGFVLNVLVLVTQIWVSIDPLHQGDTPLTTKERVRSFFVSCLAIPVVLICTIVHKWYYKTKWVRIEDMDVDTGRRDFGRLGIIKAQEKEERMGWPRWKRVYRFMC

SEQ ID NO: 11366 - protein, 410 aa, Methanothermobacter thermautotrophicus str. Delta H
MENNSQNVLKKIEDLKKEVRMLKEENSKTKRNLMWKIRKLEKDKLLIENERTRLDREVKSLRGEIERFRTPPLVIATVTEVLDDHRVAVKSTTGPHFVINYSRFIDRKQLEPGARVALNQQTFSIVDVLPSEKDPVVTGMEVEEKPDVSYEQIGGLEEQVREVKETVELPLKKPELFEKIGIEPPKGVLLYGPPGTGKTLLAKAVAHETNATFIKIVASEFVRKYIGEGARLVRGVFELAKEKSPSIIFIDEIDAVAAKRLKSSTSGDREVQRTLMQLLAELDGFESRGNVGIVAATNRPDILDPALLRPGRFDRFIEVPLPNEDGRREILKIHTSGMALAEEVDIELLARITDGASGADLKAICTEAGMFAIRDERDEVTMADFMDAVDKIMGVEKEEEYKQETGVMFG

SEQ ID NO: 11367 - protein, 100 aa, Zea mays
  unsure (1)..(100): unsure at all Xaa locations
MSGAGEEDKKPAEGGAXHINLKVKGQDGNEVFFRIKRSTQLKKLMNAYCDRQSVDMNAIAFLFDGRRLRGEQTPDELEMEDGDEIDAMLHQTGGSVPSTT

SEQ ID NO: 11368 - protein, 228 aa, Desulfovibrio desulfuricans G20
  unsure (1)..(228): unsure at all Xaa locations
MCAAQRXXXXXXXXXXXXXXXXXXXXXXXXXXXXXXXXXXXXXXXXXXXXXXXPAGRLSAAVCSPQLTAAWVTLSDKGAAGLRTDSSGPAIGEMFRGAFADSHVQGYLLPDEGAALKALLTDLALTQRYDVVFTTGGTGLGPRDVTPEATLAVIEKRLHGFEQAMMAASLCKTPHAVISRAVAGTLGTCIIINMPGSRKAVLENMQAVLPALAHASAKLRGDKADCGT

SEQ ID NO: 11369 - protein, 339 aa, Zea mays
  unsure (1)..(339): unsure at all Xaa locations
RWPGRRTRTWRHPPEALSDMISPAPLPPSSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAETKLARFVFELLSESLGMPSDHLYEMECMQNLNVVCQYYPPCPEPHRTVGVKRHTDPGFFTILLQXGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDDRALDHFRL

SEQ ID NO: 11370 - protein, 306 aa, Bacillus subtilis subsp. subtilis str. 168
MNIQRETSGHIAAIVTILIWGTTFISTKVLLADFSPMEILFYRFLMGFIALILVRPNMIPFRNWRQELLFAGAGLFGVTLYFLLENIALTYTYASNVGMIVSIIPMITAVLAHFLLEGEKLRLTFLIGFISALIGLLLITFNGNVVLRLNPLGDIMAAGAALVFGGYSIFMKKLSAYEYHIIELTQRVFLYGLLFMVPALFLFDFHFDLSRFSSASNILNMLFLGIGASALCFATWNYSVGVLGAVKSSAYIYMVPVITIAASVLILHENMTWIALLGGALTLLGLYISELKPKAKLLENGCKMDA

SEQ ID NO: 11371 - protein, 472 aa, Pseudomonas putida KT2440
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 11372 - protein, 459 aa, Chondracanthus spinosus
  unsure (1)..(459): unsure at all Xaa locations
DPDYVVKDTDALALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRSIAAAGETKGHYLNVTAATXXXXXXXXXXXXXXXXXXXXIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGTQILQDAAKTCGTLQTALELWKDMAFNYTSTDTADFVETPTANV

SEQ ID NO: 11373 - protein, 159 aa, Frankia sp. CcI3
ITKEQYSRDPRNIAKKAEAYLRGTGVADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARGRGKTV

SEQ ID NO: 11374 - protein, 457 aa, Cytophaga hutchinsonii
MYQSINPFSKENIQNLAFESIESLNEKLIRSDSAYKNWRKYSINDRKPYFKNLISVLTKEKELLAREITLEMGKPLLESIAEIDKCIGTTEWYLNNVDAIIQQHLPTVSIEHIKSQIAFEPIGAVLGIMPWNFPYWQVFRYAIPTLLIGNTVLLKHAPNVPGCAQSLEKIFKLAGFPDDLFLSLYPAVEDIEYIIASPAVQAVTVTGSERAGRSVASLAGKHLKKCVLELGGSDPFIVLADAPIKQTVAEAIKGRLQNNGQSCIAAKRFIIHEQCYDAFLKELKEQLNARIIGDPMLKETHLGPMARADLKEQLSKQVQSSVAAGADCTYKHPFDDSNSNFFSPLILENIPANSPARAEELFGPVFSCIRVTDTNEAIAVANETRFGLGASIWSNTITEAEKLSQHIEAGSVFINGITRSDARLPFGGIKQSGFGRELSVFGLQEFVNVKTYWVNEQ

SEQ ID NO: 11375 - protein, 418 aa, Grateloupia livida
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKT

SEQ ID NO: 11376 - protein, 175 aa, Glycine max
  unsure (1)..(175): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 11377 - protein, 353 aa, Magnaporthe grisea
MGCGMSTEEKEGKARNEEIENQLKRDRLQQRNEIKMLLLGAGESGKSTILKQMKLIHEGGYSRDERESFKEIIFSNTVQSMRVILEAMESLELPLEDQRMEYHVQTIFMQPAQIEGDVLPPEVGNAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSITLFLNKIDRFKEKLPISPMKNYFPDYEGGDDYAAACDYILNRFVSLNQHETKQIYTHFTCATDTTQIRFVMAAVNDIIIQENLRLCGLI

SEQ ID NO: 11378 - protein, 201 aa, Aspergillus niger
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 11379 - protein, 125 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 11380 - protein, 390 aa, Glycine max
  unsure (1)..(390): unsure at all Xaa locations
NFSSSQLLIEIEFKFEKAYLCHCTFTDLRLRASLSYFCVDLVSVKRLPFHHSPLFISFFYIDLKLKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTXVGMVIYSWAVELEKQSNAKTLPHAKNSMTEEEIRLLRDGVEKSPLKDVELGEAQG

SEQ ID NO: 11381 - protein, 234 aa, Zea mays
TRKTWFDDKPNDGTAAHVISRGGPVERGQIDEEGIREGEDLHRGLKARQISMIAIGGSIGTGLVIGSGSGLAKGGPVGLLIAYVIMGAMCFGVMCSLGEMATYLPHKKGFGGYASRFVDPSMGFALGWNYLMKYLVVTPNNITAGAIVVRYWTDKVPIGAWITIYIGGCFLVNLLGIEVFGEVEFWASFIKIIVLAGLILLGIIIDLGGAVVDRIGFRYWRGQPFSHYIFQNDT

SEQ ID NO: 11382 - protein, 143 aa, Oryza sativa
IMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATERAGAEVVECACVIELPELKGRDKLGNKPVFVLVKAD

SEQ ID NO: 11383 - protein, 177 aa, Triticum aestivum
  unsure (1)..(177): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNCXYFGCTDATQXDQRVEEVKKEYPDAYXRIIGFXTCAXXCVSSCLQHGLKIGRLTVTTAI

SEQ ID NO: 11384 - protein, 196 aa, Zea mays
MAFASSLLPVPPSRVCATPASEVAAFSPAKKSVSLAAARQRRGSRHGVRAEVNESGSVLAVDALSQVKHVLLPVLDRNPYLSEGTRQAAATTASLAKKYGADITVVVIDDKPKESVPEHDTQMSSIRWHLSEGGFSEFRLMERLGEGQKPTVIIGEVADEWDLDLVVLSMEAIHSKHVDGNLLAEFIPCPVLLLPL

SEQ ID NO: 11385 - protein, 323 aa, Oryza sativa; identical to SEQ ID NO: 1981

SEQ ID NO: 11386 - protein, 76 aa, Glycine max
QCADLHNRDHALLKTVLVINLEVKDNHDEAAVGARLTLDLCREIEAAESWEESIDEIIAGFENKHRRKLLYSISFY

SEQ ID NO: 11387 - protein, 242 aa, Zea mays
  unsure (1)..(242): unsure at all Xaa locations
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSSLATGNLQKMSETMDNFERQFVNMEVQAEFMEGAMAGSTSLSTPETXEVNSLMQQVADDYGLEGLPSGLPQAAAHAIPAAKDKXEKVDEDDLSRRLAELKAPRLKGLFQALSDAIQAYAVEPAMTHCPVDCYSCLVDS

SEQ ID NO: 11388 - protein, 90 aa, Zea mays
WETRIHISYFFQFILHFRDHSNFVTCICCASDGSKFIIVSSDKKGLTYDGKIGDKIGSISTEGGQIRSIYAVSWSLDSKHVITTSGISAS

SEQ ID NO: 11389 - protein, 89 aa, Oryza sativa
  unsure (1)..(89): unsure at all Xaa locations
GNPARTKPTDPSIELGPKFKKGGWXLGPSKSIFSIVGLAPLKVSGHVGLASSIPLKARVTIXAQPGGKLEXIPDGAVIENKDFKGPRDL

SEQ ID NO: 11390 - protein, 412 aa, Methanothermobacter thermautotrophicus str. Delta H
MEMTLMDAVLNSGDTAWMLVSTALVMLMTVPGVALFYGGLTKKENVLNTMFLSLIAFAVTSIIWVLYGYQFAFGADIMGFIGSPVNLLMNGVGVNTAAALAPTIPDFLYIAFQLTFAAITVALISGAVVERMKFSAWLAFIVLWVSLVYVPVAHWVWGGGFLAQLGALDFAGGTVVHINSGVAALALVYLLGKRKDTRLLPHNLGYSVIGASLLWFGWFGFNAGSALTAGGLAASAFLVTNTAAAAGMVSWVIMDYLKVGKPTVLGGISGAVAGLVAITPAAGFVTVPAALIIGLVTSVISYLAVSYLKPRLGYDDALDVFGIHGMSGIWGSVATGLFAAPFINELGTGLIYGNPGQLTAQVIAVAVVAAYSFVVTLIIGKLLDFTVGLRVSGKEEMEGLDTHLHEETGYRI

SEQ ID NO: 11391 - protein, 254 aa, Brucella suis 1330
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPVWAIGTGLTPTVQDVRAAHAFMREQLIERFGAKGAHLRLLYGGSVKPSNAAELLGVADVDGALVGGASLKAADFLAICETYRNL

SEQ ID NO: 11392 - protein, 531 aa, Zea mays
MSLTEAPSPSPSSSSGSDDFAAFLASELELTSGADSAFPGDPSSVFPATDDEGEDPEELEVEAIEQNGTKRRRVEEQCQDQGTSVRPDKIPTGASKIVQVEACPHPGHFGGLCIICGKPQDEEDVSGVAFGYIHKGLRLGTSEIDRLRGADLKNLLRERKLVLILDLDHTLINSTKLQDISSAEKDLGIQSAASKDDPNRSIFALDLMPMLTKLRPFVREFLKEASNMFEMYIYTMGDKAYAIEIAKLLDPSNIYFPSKVISNSDCTQRHQKGLDVILGAESVAVILDDTEYVWQKHKENLILMERYHFFASSCRQFGFGVRSLSESLQDERESDGALATVLDVLKRIHATFFDMAAETDLSSRDIRQVIKTLRKEILQGCKIVFSRVFPNNTRPQEQMVWKMAEYLGAVCVKDVDPSVTHVVTVDLGTEKSRWGLNNKKFLVHPRWIEAANFRWHRQPEEDFPVTAPKEKSKEKDSDNDVAGKKETSEDKENTAAGMKETRNDEGNVTGKDKADAKENVVTTSATCPADS

SEQ ID NO: 11393 - protein, 179 aa, Streptococcus pneumoniae
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAVSKKGPAVVEIPVNFGFQEIDENSYYGS

SEQ ID NO: 11394 - protein, 204 aa, Zea mays
MGNPEKLMAQIFDLKFTSKSLQRQARKCEKEEKEQKLKVKKAIEKGNVDGARIYAENAIRKRTEHMNYLRLASRLDAVVARLDTQAKMQAIGKSMGNIVKSLDSSLATGNLQKMSETMDSFERQFVNMEVQAEFMEGAMAGSTSLSTPETEVNCLMQQVADDYGLEVSVGLPQAAAHAIPAAKDKEKVDEDDLSRRLAELKARG

SEQ ID NO: 11395 - protein, 445 aa, Pseudomonas syringae pv. tomato str. DC3000
MTLRQFAGLGALLSLAIPGLALAADPVAEPVLNSGDTAWMLTATALVLFMTIPGLALFYGGMVRSKNILSVMMQCFAITGLISILWVVYGYSIAFDTTGMEAGVVNFNSFFGGMGKAFLAGITPASLTGPAALFPEAVFVTFQMTFAIITPALIVGAFAERMKFSAMLIFMGIWFTLVYAPIAHMVWGGVGGLMWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAITPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 11396 - protein, 298 aa, Triticum aestivum
  unsure (1)..(298): unsure at all Xaa locations
MVEIPVVDLRLAGAQPEESARLRDACERLGCFRVSGHGVRAPLQAEMQAAVRALLDLPDEAKRGNPDIVRRSAAGAPGPADPLYEAFGLXDAADPADADAFCARIEAPPRASETVKSYAEAMHALIVDVAGKVAASLRLQGHAFQDLPCQFRINGDNYTEDTVGSSGVQIHTDTGFLTVLQEDDCVGGLEVLDPATAEFVRVDPVPGSFLVNIGDVGTAWSNGRLHTVKHRVQCVAAVPRISIAMFLLAPKDDRVCAPEAFVDAQHPRRFKAFNYDDYRKLRLSTGERAGEALARMAA

SEQ ID NO: 11397 - protein, 469 aa, Porphyra pseudolanceolata
  unsure (1)..(469): unsure at all Xaa locations
VIRYAKMGYXDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 11398 - protein, 212 aa, Zea mays
  unsure (1)..(212): unsure at all Xaa locations
MDEEEHEVYGQEIPEDGDMDGADVDMAASGDDAAKLQELDEMKRRLKEMEEEXAALRDMQAKVAKEMQGGDPSTSTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYXXXYGYGRAPRFRRPMRYRPYF

SEQ ID NO: 11399 - protein, 461 aa, Oryza sativa
PVVLKPPPSMVRPAVCVVESTWDILRSFAPEEDSHAHAPASGTGGDSACQDAGEEEKLAAAVLTLEELRLGETSEEFTGTSSLSTTNDDETSSTTTESMFYISPNGRFRRKIRSWNRGMLLGSGSFGTVFEGISDEGVFFAVKEVCLCDQGSNAQQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFNVLKSCKGTVYWMAPEVVNPKTTYGPEADIWSLGCTVLEMLTRQLPYPGLEWTQALYRIGKGEPPAIPNWLSRDARDFISQCVKPNPQDRPSAAKLLEHPFVNRSMRSIRSMRTSSRSNSSNIGGMILVLLIMWSWPGRTIRYREAILSTAQSSTPTIAFHLLILSHSLLRGDMSWFSQRLIFSPENRLNVHSSA

SEQ ID NO: 11400 - protein, 351 aa, GIBBERELLA ZEAE PH-1
MSISIPSVQKAALIKNPGDEARIVIRSDIPVQNPGKNEILIKLACTGVCGSEIRALSGWGPYNPIVGHEGVGTVVKLGHDVDPNLLNKRVGVKWLYSACGECTICKRGYHNNCPKQLNTGKHVPGTLQEYMIADARYVTKIPDGVSSEVAAPLLCAGLTMAGAVSKLEGYAEKGDWVVILGSGGGLGHLGVQIAARLNGLRVIAVDTGEPRRKLSLESGAEHFIDFASENIEQRIKEITREGAAAVLVVTASQEAFIQAPNLVRNMGIIVTIGLPRNDFNIPLSASLCSARSLTVAGVAVGTETQMEELLQHASSGTIVPDITVLEFEQVGKVIRDLQDQTITGRVVVKIP

SEQ ID NO: 11401 - protein, 533 aa, Oryza sativa; identical to SEQ ID NO: 6838

SEQ ID NO: 11402 - protein, 446 aa, Zea mays; identical to SEQ ID NO: 8390

SEQ ID NO: 11403 - protein, 342 aa, Oryza sativa
CFYSFGEPFLARLPISYGGKRALYQIAEFLKYEDENSQYICIGAAQKALSMLCCWIENPNSDAFKRHLARVADFLWVGEDGMKVRVCAGQLWDVAFAVLAILACSIAEEFGSTLKKAHGFIKTSQIMDNPSGDFSRKYRHISKGGWAFQVADQGWQVSDCTAEALKALLLLSKCLSDGADYQMETYCYFDAVNVLLSLQNPNGGYGAWELARTYPWMEIFNMTEIYADIIVEHQYVECTSSVIQALALFREKYPGHRKDEIDQCIRKATEFIEKLQNDDGSWFGSWGICFTYGTWLAIEGLSAVGQCYDDSTCIRKACKFFVSKQLTNGGWGEESSFIQNQD

SEQ ID NO: 11404 - protein, 289 aa, Yersinia enterocolitica
MKGIVLAGGAGTRLHPITRGVSKQLLPVYDKPMIYYPISVLMLAGIQDILIISTPEDLPSFKRLLGDGSQFGIRLQYAKQPSPDGLAQAFIIGEEFIAGERCALVLGDNIYFGQSFGKQLREVASRNDGATVFGYQVVDAERFGVIEFDENFNALSIEEKPQKPKSDWAVTGLYFYDKDVVEMAKEIKPSERGELEITTLNEMYLAKGKLRVELLGRGFAWLDTGTHDSLIDASLFIHTIEKRQGFKVACLEEIAYQNQWLSREKLNELAEALNKTYYGQYLLKLAKES

SEQ ID NO: 11405 - protein, 426 aa, Bacteroides thetaiotaomicron VPI-5482
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 11406 - protein, 575 aa, Brassica napus
MDRIIARMKKSSGRRGDKTPTRRLERRDALKHINYDAASTSTWSAEDISASLVTRSLELPDRTSFRIFGGGDVEMDQIYKSLGLSGPDDLAISFDAWEACKKRSSSDVINRFKSFELDLHNFPVPSLSEAAPSYGGMGENKPCLERTPTITVKSRGYLVPNHGDVASGGGAGEDKRGLVRTPTITVKSRGYLVPNQSDVGIKGVRPPVLKPPPAKRPPIDHQGSSWDFLTHFAPEDGIVRRPSSSSTSDNGEETLEEEVDTGDEACSFSTNEGGGDSSSTVSNTSPIYANGGSIITSWQKGGLLGRGSFGSVFEGISGDGDFFAVKEVSLLEQGSQAQECIQQLEGEIALLSQLQHQNIVRYRGTAKDGSNLYIFLELVTQGSLSKLYQRYQLMDSVVSTYTRQILDGLKYLHDKGFIHRDIKCANILVDANGAVKLADFGLAKVSKLNDIKSCKGTPFWMAPEVINPKRTDGYGSSADIWSLGCTVLEMLTGQIPYCDLENPVQALYRIGRGVLPDIPDTLSLDGRDFITECLKVDPEERPTAAELLNHPFVRRPLAYSGSGLGSASPHVHRRG

SEQ ID NO: 11407 - protein, 98 aa, Glycine max; identical to SEQ ID NO: 11186

SEQ ID NO: 11408 - protein, 318 aa, Oryza sativa; identical to SEQ ID NO: 5104

SEQ ID NO: 11409 - protein, 484 aa, Lactobacillus plantarum WCFS1
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAAFSPDSVRGETRAQPYRYQVDYTTQAGDLYRLMSEPEQERLINTIKDALGQVTLPGVKELEIKQFYEADKNYGTRVANALGMNIADIISD

SEQ ID NO: 11410 - protein, 322 aa, Zea mays
PTRPPTRPRTRGRTRGRTRGRTRGALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 11411 - protein, 445 aa, Zea mays
MECIAEMPRAPLDSRLRKRQRLGWDVGPAEMYKAVRPRHGWDVGPAEMYQLGLCGQEVVNAISAAALGLSSGCVSSQVKQEQPHHGSPPLREDDRDGHYVFAVGDNLTSRYKINAKMGEGTFGQVLECWDKERKEMVAIKIIRGIKKYRDAAMIEIGMLEQLGKYDESRSSCVQIRNWFDYRNHICIVFERLGPSLYDFLRENSYRSFPIALVREIAKQLLECIAFMHELCLIHTDLKPENILLVSPEYIKVPDYKVSSRSPKEGSYYKRVPKSSAIKVIDFGSTTYDQQDQSYIVSTRHYRAPEVILGLGWSYPCDIWSVGCILVELCTGEAIFQTHENLEHLAMMERVLGPLPYHMFKRADRHSDKYIRKGRLNWPEGCTSRESMKAVMKLSRLQNLVMQNVDQAAGDFIDLLQGLLKYDPSSRLTAREALRHPFFTQGFWRR

SEQ ID NO: 11412 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 11413 - protein, 150 aa, Chlamydophila caviae GPIC
MQLLSPAFDYGKPIPRKYTCQGVNISPPLIFKDIPAEAKSIALIVEDPDVPQNLRADGLWIHWLVYNLSPTITELVEGANIFAVQGLNTSGKACYEGPCPPDRQHRYFFYCYALDTILPSEENVTKDQLLEVMESHVIDNAELMGTYEKS

SEQ ID NO: 11414 - protein, 101 aa, Zea mays
KKIFKTQDLESGCLLYGALLDDIGIDLPKAPTQFGEIIARLTLLGALRFEVMEEILKKMEDTMYRKAVFDAVKKTLEANPSGQTILGSHAAVIDACNSLLE

SEQ ID NO: 11415 - protein, 277 aa, Oryza sativa
MGILSLITGKAGASGFGSGSTAEQVTAGVDATGLTVIVTGGASGIGLETSRVFAMRGAHVIIAARNTEAASVVRKKIIEENPKAHIDVLKLDLSSLKSVRAFADQFNSMNLPLNILINNAGVMFCPFGLSEDGVEMQFATNHLGHFLLTNLLLDNMKATAKSTGIEGRIVNLSSVAHLHTYPKGIEFDKLNDEKTYDDKMAYGQSKLANILHAKELSRRLKGAATTCYVGLNPQLKGVTGQYFADCNVEKTSRFARNDALAKQLWEFSEKLIKSSSK

SEQ ID NO: 11416 - protein, 48 aa, Phanerochaete chrysosporium
IIAKEGVKSLFKGAGANILRGVAGAGVLSLYDKLQQVLFGKVYSGGSG

SEQ ID NO: 11417 - protein, 341 aa, Glycine max
IRLERLEQRLTKCQPFDAPEPNQLIWPNLKIKYFQRELRQYLVYFIVALTIFFYMIPITFISAFTTLDNLVKYLPFIKPIVNIKALRTVLEAYLPQLALIIFLALLPKLLLFLSKFEGIPTESHAVRAASGKYFYFTVLNVFIGVTIGGTLFKAFKRIREHPTLDEISSLLAESLPGNATFFLTYVALKFFIGYGLELSRIVPLIIYHLKRKYLCKTEAELKEAWRPGDLGYGTRVPGDMLIVTIVFCYSVIAPVIIPFGALYFGLGWLVLRNQALKVYVPTFESYGRMWPHIHNRILASLILYQITMFGYFGTQKFYYTPLVLPLPILSLIFGFVCAKKF

SEQ ID NO: 11418 - protein, 305 aa, Zea mays
  unsure (1)..(305): unsure at all Xaa locations
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEALGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLXATPADAALMMQLGCDGVFVGSGIFKSGDPARRARAIVQAVTHYSDPTILADVSTGLGEAMVGINLNDPKVERYAARSE

SEQ ID NO: 11419 - protein, 603 aa, Oryza sativa; identical to SEQ ID NO: 3171

SEQ ID NO: 11420 - protein, 217 aa, Lactobacillus plantarum WCFS1
MKFFLDTANTEDIKHFAELGLVDGVTTNPTLVSREGRDFETVIKEITQIVSGPVSAEVTATKAEEMIAQARNEIKWASNIVVKIPMTEEGLKAVKVLSGEGIKTNVTLVFSVSQGLLAAKAGATYISPFLGRLDDIGGNGIQLVKDLRQVLDTYGFKTEIIAASVRGPQHVQEAALAGADIATIPATVFGKLWSHPLTDKGLASFASDWKAFQATQK

SEQ ID NO: 11421 - protein, 448 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEQAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 11422 - protein, 70 aa, Gossypium herbaceum
HVDILLASVILVIVVKTAVVCVVAKAFGYSVRTSFHVGVLLAQIGEFAFVLLSRASNLHLVEVPLSSLPF

SEQ ID NO: 11423 - protein, 188 aa, Zea mays
  unsure (1)..(188): unsure at all Xaa locations
MEASPNDRLHFGKMGFGCQHYRRRCQIRAPCCNEIFDCRHCHNEFTSTLRNIYDRHELVRQDVKQVICSVCDTEQPVAQVCSNCGVNMGEYFCNICKFYDDNTEKQQFHCDDCGICRVGGRENFFHCKKCGSCYATGLRNNHRCVEDXMRHHCPICFQDLFDSLKKTAVMKGEHTMHCECYHEMIKRD

SEQ ID NO: 11424 - protein, 243 aa, Zea mays
  unsure (1)..(243): unsure at all Xaa locations
MAFDAFTDKTAVFRRLKAKPENKMCFDCNAKNPTWASVTYGIFLCLDCSAFHRSLGVHITFVRSTNLDSWTPDQLKMMAFGGNNRAHAFFKQHGWTEGSGKVDSKYTSRAAELYRQILQKEVAKSSTVNVLPSSPVAASQPPNPTDDFPDFKLADAPEETTNGKHEPLVANPPKEPAQAPKAPTHPTYVSSVKKPLGAKKVGAKTGGLGXKKLTTKSNESLYDQKPEEPKPALPXMTTTTSAA

SEQ ID NO: 11425 - protein, 434 aa, Picea abies
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGKEAEAIKAKILAHPQYPSLLGAYIDCQKIGAPPEVVARLDALTHEYENQQHRTTVSIGMDPELDQFMEAYCEMLTKYHEELTKPFKEAMSFLKKIEAQLNSLSKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATLYVERHLMTEGYHLDC

SEQ ID NO: 11426 - protein, 224 aa, Desulfitobacterium hafniense
MIKIAPSILSADFAHLGDQVALVEKAGAEVLHIDVMDGHFVPNITIGPLVVKALRPYSQMRFDVHLMIEHPERFIEEFAKAGADHITVHLEATPHIHRAIQQIKGLGLTAGVSINPATPLDGIKYILDELDMVLIMSVNPGFGGQKFIPAVLPKIEVLHRHLDQMQSSCEIEVDGGINLDTAPAVVKAGANILVAGAAVFACADPARAVQELREAAQGYKGDPK

SEQ ID NO: 11427 - protein, 448 aa, Streptomyces coelicolor A3(2)
MAPAITLAAETELSAANTGFMLICSALVMLMTPALAFFYGGMVRVKSTLNMLMMSFISLGIVTVLWVLYGFSMAFGTDSGSVVGWNSDWVGLSDIGLTELWDGYTIPVFVFLVFQLMFAVLTPALISGALADRVKFTAWALFIALWATIVYFPVAHWVWGAGGWAFELGVIDFAGGTAVHINAGAAALGVILVIGKRVGFKKDPMRPHSLPLVMLGAGLLWFGWFGFNAGSWLGNDDGVGALMFVNTQVATGAAVLGWLAYEKIRHGAFTTLGAASGAVSGLVAITPAGGAVSPLGAIAVGLVAGVVCAMAVGLKYRFGYDDSLDVVGVHLVGGILGSLLIGFFASGKGQSDVEGLFYGGGLDQFWKQCAGVFGVLAYSLVVSAVLAFLLDKTIGMRVSEDVEVAGIDQAEHAETAYDFSGAGGGAARTTATPAASTAGSAPSKKVDA

SEQ ID NO: 11428 - protein, 506 aa, Arabidopsis thaliana
MVENLFPSRFQFHLQRLDPKRRLTSLLASHKTLFTFLWITAFGSVFLWQRTAYIEGGSGTGPVGGKFTIFGKIKPIQPIPRLRPVVFDLKDFGGVGDGFTLNTEAFERAVISISKLGGSSGGGQLNVPPGRWLTAPFYLTSHMTLFLAEDSEILGVEDEKYWPLMPPLPSYGYGRERPGPRYGSLIHGQNLKDIVITGHNGTINGQGQSWWKKHQRRLLNYTRGPLVQIMWSSDIVIANITMRDSPFWTLHPYDCKNVTIRNVTILAPVTGAPNTDGIDPDSCEDMVIEDCYISTGDDAIAIKSGWDQFGIAYGRPSTNILIRNLVVRSVISAGVSIGSEMSGGISNVTIENLLIWNSRRGIRIKTAPGRGGYIRNITYKNLTLDNVRVGIVIKTDYNEHADDNYDRKAYPILSGFSFAGIHGQGVRVPVRIHGSEQIPVRNVTFRDMSVGLTYKKKHIFQCSFVKGRVFGSIFPRPCENFDVYDEEGRLVKPAAESNVADIDYDI

SEQ ID NO: 11429 - protein, 309 aa, Photobacterium profundum
MTPITRVAIIGECMVELKKNDGSIEQSFGGDTLNTAVYLSRLTQQHGISTSYVTGLGRDPFSKEMLAAWREEGINTDMVYLSDDKLPGMYAIETTEDGERSFYYWRNDSAAKYWLRERAILTLAKELCQHQMVYLSGISLAILSEDCRQSLINLLALCCKDGLKIAFDNNYRPTLWESAEQAQTFYKQILAITDIAFLTFDDEQMLYGDDNEQQTIERTQALGVQEIVIKRGGDDCYVVTPGSLECVAPHPVGNIIDTTAAGDSFSAGYLAKRITGGTPHASALAGHLLAGNVIQHRGAIISRDDMPNI

SEQ ID NO: 11430 - protein, 213 aa, Vibrio vulnificus CMCP6
MSEKSQCVIVGIAGASASGKSLIASTIYNELRAKVGDHQIGVITEDCYYNDQSHLSMEERVKTNYDHPNALDHDLLCEHLEKLMKGESVEVPEYSYTEHTRTENTTTMTPKKVIILEGILLLTDPRLRDLMHATVFMDTPLDICLLRRVKRDVEERGRTMESVLKQYQKTVRPMFMQFIEPSKQYADIIVPRGGKNRIAIDVLKAHIAKLLKA

SEQ ID NO: 11431 - protein, 433 aa, Photobacterium profundum
MSKIVKVLGREIIDSRGNPTVEAEVHLEGGFVGMAAAPSGASTGSREALELRDGDKSRFLGKGVLKALEAVNGPIAEALLGKDATDQAAIDQVMIDLDGTENKSKFGANAILAVSLANAKAGAAAKGMPLYEHIAELNGTAGQFSMPLPMMNIINGGEHADNNVDIQEFMIQPVGAKTFREAVRIGAEVFHNLAKVLKAKGLSTAVGDEGGFAPNLESNAAALAAIKEAVEAAGYELGKDVTLAMDCAASEFYDKEAGNYNMKGEGKIFTSEEFNFYLQDLANQYPIVSIEDGLDESDWAGFKHQTELLGDKLQIVGDDLFVTNTKILAEGIEKGVANSILIKFNQIGSLTETLAAIKMAKDAGYTAVISHRSGETEDATIADLAVGTAAGQIKTGSMSRSDRVAKYNQLLRIEEALGAKAPFNGLKEVKGQA

SEQ ID NO: 11432 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 11433 - protein, 193 aa, Haemophilus influenzae Rd
MANILFLDNFDSFTYNLVDQFRVLGHNVTIYRNDCDLEKLVETALNTPDTILALSPGPGTPSEAGILLPLIERLKNQVPIIGVCLGHQALIQAFGGKVVHAGEVLHGKVSRISHDNEAMFKDLANPMPVARYHSLMGQDLPKEFIVNAEYNGIIMAIRHRDLPICAFQFHPESILTVQGSQLLQQSIEWLLNR

SEQ ID NO: 11434 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFFNDLERCERITKALEVGAVWVNCSQPCFVQAPWGGIKRSGFGRELGEWGIQNYLNIKQVTQDISDEPWGWYKSP

SEQ ID NO: 11435 - protein, 507 aa, Zea mays
  unsure (1)..(507): unsure at all Xaa locations
MSARRSSAGSDDRDQARLQQLGYKQELKRGLSVVSNFAFSFSMISVLAGVTTTYNTGLRYGGPASMTLGWLVVALFNGCVALSMAEICSAYPTTGGLYYWSAKLAGKDWGPLACWVTGWFNIVGQWACTTSVDFSLAQFVQVIVLLATGGANGGGYLASKYVVLAIYCAILVLHGLINSLPIXWLAFFGQLGAFWNLGGVCLERASMEFMFTHCYTDDAVGIHSKVYVLAIGLLTSQYSLLGYDTSAHMSEETKNAEWSGPMGIVVSVALSSVFGWIYLVALTSAVTADDVPSLLDPTNDAGGNAIAQALYATFRRRFGSGAGXVLCLAAMAVAIFLCGVASVTSNSRMGYAFSRDGAMPLSQVWYRVNKQEVPFNVVWLSVSVAFVMALTSLGSQVAFQAMVSITTLGMYIAYALPIFFRVTAARNSFVPGPFHLGRRCSLVVGWVAVLWVALVTVLFCLPVAYPVAGVNFNYTPVAVGGVLVLSLGAWVLHARFWFRGPVTTIDA

SEQ ID NO: 11436 - protein, 264 aa, Zea mays
  unsure (1)..(264): unsure at all Xaa locations
EWPRRRRPSCPPISPASPTSAARRRRPLPPSHSSFASAARAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVQG

SEQ ID NO: 11437 - protein, 347 aa, Streptococcus agalactiae NEM316
MFVKKGLFVFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMVVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 11438 - protein, 394 aa, Zea mays subsp. mays
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKXVSGGGXDMMDWLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 11439 - protein, 518 aa, Cucumis melo
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 11440 - protein, 65 aa, Zea mays
  unsure (1)..(65): unsure at all Xaa locations
MILFCSTSFYRFQILRELLPHNDQKRDKATFLLEVIPXKRFLQEKAQKYEATFPEWNQENPKMLP

SEQ ID NO: 11441 - protein, 368 aa, Oryza sativa (japonica cultivar-group)
MRQWFCCNCHFDEEDDHGKERSNAQGNKMDAKQKSSKPPAGQPEPEIAPLTIDVPELSLEDLKQKTDNFGSNALIGEGSYGRVYHATLDDGRQAAVKKLDASENEPNDEFLKQVSQASRLKHENLVEMLGYCVEGNYRILAYEFATMGSLHDVLHGRKGVQGAQPGPVLDWTQRVKIAIEAAKGLEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKSEYPPKGVAKLAAVAALCVQYEAEFRPNMSIVVKALSPLLQQKPAVPAASEPAPATEN

SEQ ID NO: 11442 - protein, 234 aa, Ferroplasma acidarmanus
MQQGQMAYDRAITVFSPDGRLFQVEYAREAVKKGSTALGIKFKDGVLLLSEKKARSRLVEKNSLEKIQLVDDNVATVTSGLVADARVLIDFARVGAQQEKVTYGSLTNIENLVKKVADQMQQYTQFGGVRPYGVSIIFAGTDTIGPRLFDCDPAGTINEYKSVAIGAGKDAVTDYIEKEYKDDMSLEDTIKLGVAALKSALADASSMKEPEIASIKVGETFHVYTNEEVSKYLN

SEQ ID NO: 11443 - protein, 142 aa, Glycine max
MVLESTMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIVFIGSPVTYDKKVLETIGKKLKKNNVALDVV

SEQ ID NO: 11444 - protein, 473 aa, Magnetococcus sp. MC-1
MKKAYVAGQWVETGTQLKVYNPYNDQLVDTVAQCGPHEIDRALDGAVDALEQTSRMQPYERAACLAKIRDGIAARGAEFARVLSLENGKTLAESTLEVARAVATFDIAVGEATRIYGEAYDLGINPMGSGRRALVRKYPIGVVSAIAPFNFPINLAVHKIAPALAVGCPVVLKPASLTPLTALMMAEVVEASGWPKQAFSVVPCNRSAGQMLVEDERIKLLSFTGSPEVGWKMKSEAGKKKVVLELGGNAGLIIDHNVKDWDHLIQRAILGAFYQCGQVCISVQRIFVHQDVMGEFRARFAKAAQALVIGDPLDAKTTLGPVIDRANVERLQGWIQEALDQGAALVTGNTIADVGAGNSMTATILEEVDAGCRINADEAFGPVVTLTPVQSMDEAFHLVNNSRFGLQCGLFTQDFATVMRALDQLEVGGVIHNDVPSFRVDSMPYGGVKDSGLGREGVKYAMEDMLEPRVLVY

SEQ ID NO: 11445 - protein, 302 aa, Zea mays; identical to SEQ ID NO: 11067

SEQ ID NO: 11446 - protein, 212 aa, Zea mays; identical to SEQ ID NO: 5769

SEQ ID NO: 11447 - protein, 304 aa, Streptococcus thermophilus
MKNQKVRKAVIPAGGLGTRFLPATKALAKEMLPIVDKPTIQFIVEEALKSGIEDILVVTGKSKRSIEDHFDSNFELEYNLEQKGKTDLLKLVNDTTSINLHFIRQSHPRGLGDAVLQAKAFVGNEPFVVMLGDDLMDITNDKAVPLTKQLINDYEETHASTIAVMPVSSEEVSAYGVIAPQGKGENGRYSVETFVEKPNPEDAPSDLAIIGRYLLTPEIFGILENQEPGAGNEVQLTDAIDTLNKTQRVFARVFTGDRYDVGDKFGFMKTSIDYALKHPQIKDDLKQYLIELGHKLEGKPTKKG

SEQ ID NO: 11448 - protein, 131 aa, Triticum aestivum
MANDERGAGEERGAAEDSIVWREEAGKFETPDGEAFLQYRLVVQPRASSVRGGASPAAMDMVHTYVPGSKRGQGLAARLCDAAFAHAQRHGMRVIPACSYISDTYLPRNPAWNELVYKADEPKHSSTSSSM

SEQ ID NO: 11449 - protein, 308 aa, Zea mays
PRASWPEVTPMTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 11450 - protein, 92 aa, Triticum aestivum
MAGKARVFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 11451 - protein, 397 aa, Zea mays
  unsure (1)..(397): unsure at all Xaa locations
MEAPPVPELMDLDAPPPAGSXAVSDKKKEGEGGDTVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPPLFNFKHELANASPDLINRLVPEHIRRQNGVNFGHIGS

SEQ ID NO: 11452 - protein, 539 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADIVWRVIVMLGAAPALLTYYWRMKMPETARYTALVAKNAKQAAADMSKVLHTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 11453 - protein, 304 aa, Zea mays
  unsure (1)..(304): unsure at all Xaa locations
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIXELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 11454 - protein, 535 aa, GIBBERELLA ZEAE PH-1
MGWNTHASGTNDPPEVRNWRIHLIATVASMSALAIGYDTSVIGGTMALTSFMRDFGLDLVEKTQRDTIQGNIVSTFQAGCFFGALCTFPIAEKWGRRKTIMAAACIFLLGGALMTAANGNLNMIYAGRAVAGLGLGASSLTVPVYISETAPPSIRGRLIGIFEIASQGGGMLGFWINYATDRTIDVNTKTQWIVPLGLQLLPGAGLALGMLWCPESPRWLARGDRFEEAEKILSQIRGMTPDHEYIRREMGDIRAQVEERSTNKMSKKQMFMKLFQKGVRNRMGIGMALMFLQSFTGVNIITYYAPRIFESLGIPGTSLKLFSTGFYGISKTLGMVLFTFWVVEKVGRRKGLIWGAALGCIPMLYIGGYVMKADPAAAAAAGVVNRDGWGYLAIVCVYINAIIICATWQGITWTYASEIFPLDIRMLCVAITTADTWLGSFIIARSTPYMISDLGYGAYFFFGSILVLMGIWSLFFVPETKGITLEDMDALFAKPVYKTVWAQMRGKPVLEGNAANRSDSPFDEDDEKARELRIP

SEQ ID NO: 11455 - protein, 736 aa, Podospora anserina
MASYLPSMEKVQHAVLGPRGGDKVADLQKETKEMSDKARLTTDYGVKQTSADDWLKIVNNDKTGPMLLEDPFARERIHRFDHERIPERVVHARGSGAFGKFKLFESAEDVTFAPILTDTSRETPIFIRFSTVLGSRGSADTVRDVRGFAIKFYTQEGNWDIVANNIPVFFIQDAIKFPDVIHAGKPEPHNEVPQAQTAHNNFWDFQYNHTEATHMFMWAMSDRGIPRSYRMMQGFGVNTFTLINAKGERHFVKFIFTPELGVHSLIWDEALKLAGQDPDFHRKDLWEAIENGVFPKWKFGIQVIPEADEHKFDFDILDATKIWPEDLVPVRYIGEFELNRNPDEFFPQTEQVAFCTSHIVPGIGFSDDPLLQGRNFSYFDTQLSRLGINWQELPINRPVCPVMNFNRDGAMRHTITKGTVNYWPNRFEKVKPATHEEGGYVEYAEKVAGIKARARSAKFKEHFAQAQLFWNSMSAVEKNHIINALGFELDHCEDPVVYERMVTRLADIDLGLAQTVAEMVGGEPPKEASRPNHGRKAPGLSQTEFPGSKPTIASRRIAILVADGYDQVAYSAAYAAISAGLAIPLVIGTKRSKIVAAGGAGSTTPHHHLEGFRSTMVDAIFIPGGVDSIRALSKNGRALHWIREAFGHLKAIGATGEAVDLVNKAIGLPAVSVSESAEVQDSYGVVTMRETKPGSLSEAVDIVKAGAGFMEKFFHNIAQHRCWARELDGLHSQVAY

SEQ ID NO: 11456 - protein, 362 aa, Eremothecium gossypii
MSQQDQFIADDVTSNQSNVTRQMLVKEYKRIGHGAFGTVVQAYLTPDNEKWYGPFAIKKVPAQTEYKSRELAILRIADHPNVVKLEYFFTHVSPSDGKVYQHLAMECLPETLQHEILRYTQNKLELPLKHIKMYTYQIARGMLYLHALGICHRDIKPSNILVDPKSGVLKICDFGSAKKLEQNQPSISYICSRFYRAPELIVGCTQYTTQIDIWGLGCVIGEMLIGKAVFQGQEPLLQLHEIAKLLGPPDKKFIFFSNPSYGGPLFSKPLFNGTPQQRFEKYFGHAGPEGIDLLMKVLCYSPERRLSPRRVLCHAFLDELRNDRYFFPAGSSQPKQMPELFDFSEFELEIIGTLLPSIVGHE

SEQ ID NO: 11457 - protein, 149 aa, Zea mays
MMMSAKKIAHLAKKWQRMAAQGRKRLTLGAAAAKEVDECCGSVASKGHCAVYTADGARFEVPLACLSTPVFRELLQMSQEEFGFAGGDGTGRITLACDAAVMEYAMCLLRRGASAELEQAFLSTMAMSCHCASYMAPYVGRARQHQIVV

SEQ ID NO: 11458 - protein, 99 aa, Zea mays; identical to SEQ ID NO: 6408

SEQ ID NO: 11459 - protein, 417 aa, Streptomyces hygroscopicus
MTPQQRSAVLSRAAALLESRAEEFSALITSESGVCRKETLREVSRAAGNLKVAAAEAERIRGESIPLPDGTRLAVTLPEPVGVVLGITPFNRPLNQVVVKAAPALAAGCPLLLKPSEKTPLTALAFAELLIEAGCAKDMLGVVTGEPGELGPLLASHPDVAMVTFTGSVATGHSVAALAAGKRQLLELGGNDPLFVLPDADLPHAARLAAGGACATAGQSCRGIKRIFVWEEVADEFTDLLSTEVAGKQAGDPRRSDTDLGPLISEEAALVVERRIADAVRDGARLVTGGERDGALVHPAVLDRVPADTELVREETFGPVAPVIRVRGADEAVRLSNSTAYGLQAGVLTRDSARFWDLAARLRVGAVNLGEGPHFDSPHIPFGGVKACGIGREGIRYAIAEMTVTKTVTLPGPYGTG

SEQ ID NO: 11460 - protein, 377 aa, Prionitis lanceolata
VETDDGNFRAMVPSGASTGIYEAHELRDGDPKVFNGKGVLKAIDNVNNELAVAVTDMDPTDQGGIDQALVDCDGSSDSSKSRLGANAILGVSMAVARAGAAKKGIPLYKHINNLAGNPTLMLPVPCFNVINGGSHAGNGLAFQEFMILPTGAETFKEAMRIGVEVYHKLKRTLEESYGKASTAVGDEGGFAPDIHDNEQALKLVQSAVKESGYEGVIQIGLDVAASEFYDKESGRYNLSLKTKVNGAAAGQLRSASELLHTYKLYAANYGVTSIEDPFDQDDFPSFESMTAELGEVIQIVGDDLLATNPNRIETAVERSACNALLLKLNQIGTVTEAIEANNTARDAGFGVMVSHRSGETEDPFIAALCVGLGTGQI

SEQ ID NO: 11461 - protein, 318 aa, Triticum aestivum
FPLYERLLEGQVNLQRGAAPVDQLPRIDAQIAARAPPPMPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGELPGDTASTLKAWWQAHAKWPYPTEEDKARLVQETGLQLKQINNWFINQRKRNWHSNPTSCSSDKSKRKRNYAAGSSTSASGTGTATLPRPRQTRAKEKGAMQLRATPSSPGRAGAVGRRAKNEERMPPYMYIALPSWRRL

SEQ ID NO: 11462 - protein, 416 aa, Burkholderia fungorum
MPAVKPILKSNKLLNVCYDIRGPVLEHAKRLEEEGHRIIKLNIGNLAPFGFDAPDEIIQDMILNLPGSSGYSDSKGVFAARKAIMHYTQQKGVHGVELDDIYIGNGASELIVMALQGLLNDGDEVLLPAPDYPLWTAGVSLSGGTPVHYICDESNSWMPDLDDIRAKITPNTRALVVINPNNPTGALYSDELLLGLIEIARQHGLVIFADEVYDKIVYDGKKHTSMAALSEDVLTVTFNSLSKSYRSCGYRAGWMFISGLTAGENRRHAKDYFEGLGILASMRLCPNVPGQYAIQTALGGYQSINDLIVPSGRLYKQRELAYDMLTAIPGVSCVKPEAALYMFPRLDPKIYPIQDDQQFILDLLLEERVLLVQGTGFNWPTPDHFRVVFLPNVDDLADSINRIARFLDGYRKRHTA

SEQ ID NO: 11463 - protein, 312 aa, Eucalyptus globulus
ANLFAMQLASASVLPMVLKAAIELDLLEIMAKAGPGAFLSPGEVAAQLPTQNPEAPVMLDRISRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNNGKVIVAECVLPVYPDTSLATKNVIHIDCIMLAHNPGGKER

SEQ ID NO: 11464 - protein, 82 aa, Viscum album subsp. album
GFAWSWGPLGWLIPSETFPLETRTAGFSFAVSSNMLFTFVIAQAFLSMLCSLRAGIFFFFAAWIVVMGLFALFLLPETKGIP

SEQ ID NO: 11465 - protein, 388 aa, Glycine max
MVDQVQHPTIMDKVAGQLHLRSGVSGIRSYEGAYCHPTMYQRPSFGNYSNAALQYPVMPSCKATMDLSAAATTASPVFVAAPAEKGHFLIDFLMGGVSAAVSKTAAAPIERVKLLIQNQDEMIKTGRLSEPYKGIGDCFKRTMADEGVVSLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLASDGVAGLYRGFNISCVGIIVYRGLYFGLYDSVKPVVLTGSLQDSFFASFALGWLITNGAGLASYPIDTVRRRMMMTSGEAVKYKSSLDAFTQILKNEGAKSLFKGAGANILRAVAGAGVLAGYDKLQVLVFGKKYGSGGA

SEQ ID NO: 11466 - protein, 360 aa, Lactococcus lactis
MSWQNNLRSVSPYIAGEQPELTDMIKLNTNENPYPPTSVAQLFNERYKTKNLRLYPSTDAKSLRKKLAEYHHLEVEQVFIGNGSDEVLSLSFLTFFNSQSPLLMPDITYSFYPIYCELYRIPFQKVPVDDDFKVSIKDYCIENGGIVIANPNAPTALALNLKDIEEILKKNQNSIVLIDEAYIDFGGETCLPLLKKYDNLVVVQTFSKSRSLAGIRLGVAYGSAEAISHLYDVKNSFNSYPIDSLAQIIGEASLMDEHYFQKNIQKIIKTREVFKDNLVNLGFEVTDSKANFVFVHHPKVKAEDLFKALYEAKIIVRHWNQPRIDDWLRITIGTNKEMNKVIEFLKGYLKKNEEIDEWKK

SEQ ID NO: 11467 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 11468 - protein, 353 aa, Haloferax volcanii
MVSVTDLQTMYEQMVTARHYEERLVDEYLVGKQPAFDISAGPIPGELHLAAGHEASGAGVCMHLRDDDTVTAPHRPHHIAIAKGVDLKRMTAEIFGRKTGLCRGKGGHMHLFDPDVNFACAGIIAQGCPPAVGAAMAAKKRNTDSVAVAFLGEGAIDQGGFLESLNLAAVHDLPVVFVVEDNDWAISMPKDRVTDVQNGAQRAAGFDLPGVRIDSDDATAVYEAAGEAVMRARDGNGPTLIEVQVHRRMGHFMGDAEAYRPEADIDRAKQRDSIERLAADLRSHGVTDDDIDEMRERAHGRVEAAISWAKEQPEPEPAEAYENVFTNPPAQAATDGGSAADAPGDAGETGGDN

SEQ ID NO: 11469 - protein, 336 aa, Triticum aestivum
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 11470 - protein, 250 aa, Glycine max
MSRRYDSRTTIFSPEGRLYQVEYAMEAIGNAGTAIGILSKDGVVLVGEKKVTSKLLQTSTSTEKMYKIDDHVACAVAGIMSDANILINTARVQAQRYTYAYQEPMPVEQLVQSLCDTKQGYTQFGGLRPFGVSFLFAGWDKNFGFQLYTSDPSGNYGGWKAAAIGANNQAAQSILKQDYKDDITREEAVQLALKVLSKTMDSTSLTSEKLELAEVFLSPSGKVKYQVCSPENLTKLLVKFGVTQPATDTA

SEQ ID NO: 11471 - protein, 278 aa, Parmeliopsis ambigua
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 11472 - protein, 180 aa, Campylobacter jejuni subsp. jejuni NCTC 11168
MDTINIGILTLSDRASSGIYEDKATAEIERVLNSYIKNDIIYHKELIPDDYDLIIKKLLYLADEKKCDLIVTSGGTGPALRDVTPEATEAVCDKMMPGFGELMRLESLKYVPTAILSRQSAGIRNKSFIINLPGNPKAIKECLEPVFPAIPYCIDLIEGAYIEANDEVIKVFRPKKKCQN

SEQ ID NO: 11473 - protein, 235 aa, Triticum aestivum
AKKTPRSTKSLRYPLPLLCSRSPQRSPLSSSPPRLPRRRSARFVSPAFAARAVDGVRQQKVSAILFPSSALSRSSPPSLPPSSALRRLLAPPRSPRALARPMASGDSKPRSEEEWRAVLNPEQFRILRLKGTELPGTGEYNKFYGDGAYKCAGCGTPLYKSTTKFDSGCGWPAFFEGLPGAIHRTPDPDGRRVEITCASCGGHLGHVFKGEGFKTPTDERHCVNSVSIKFTPASS

SEQ ID NO: 11474 - protein, 171 aa, Rhodococcus rhodochrous
MSSETRVGNGGDLLVQVLREAGVDTVFGIVSVHNQPLVEAVSRELRFVPVRHEATAVNAADGYARATGRLGCALTSTGTGAGNAAGSLIESLSAGTSVLHVTGQVESQYLGSGRGFIHETKNQWGMLDAVSVHAETVRDADTAGKVLREAVARSLSTPGGPVSVEWPIDLQ

SEQ ID NO: 11475 - protein, 333 aa, Desulfovibrio vulgaris subsp. vulgaris (strain Hildenborough)
MSLNLGINGFGRIGRYLVRLLAEDNELSIAAINARADNASLAHLFKYDSCHGRFNGEVGHDADGLIVNGRHIAVTREKINEWRWGELGIDLAVETSGTVKDRAGLAQHIARGAKKCVISAPGKDADVTIVMGVNHGDYDPAKHDVISAASCTTNCLAPAAKVVHETFGIRHGIMTTVHSYTMSQRILDGSHKDLRRGRAAALSMIPTTTGAAKATALVYPALAGKLDGMAVRVPTPNVSLVDLTCELERETTVEEVNAALKAAAAGPMLGNMGFCEEPLVSIDFMGSTFGGVVDAQCTSVIDKTMLKLIIWYDNEAGFTNQLVRLLRMVGKSL

SEQ ID NO: 11476 - protein, 176 aa, Helicobacter pylori 26695
MQTIHIGVLSASDRASKGIYEDLSGKAIQEVLSEYLLNPLEFYYEIVADERDLIEKSLIKMCDEYQCDLVVTTGGTGPALRDITPEATEKVCQKMLPGFGELMRMTSLKYVPTAILSRQSAGIRNKSLIINLPGKPKSIRECLEAVFPAIPYCVDLILGNYMQVNEKNIQAFRPKQ

SEQ ID NO: 11477 - protein, 120 aa, Zea mays
  unsure (1)..(120): unsure at all Xaa locations
MAAACDAYTDKNAVFRRLKAMPENKMCLDCNAQIPTWASVTXYGIFLWLDCCAAHRSLGVHITFVRSTNLDXWTPYQLKMMAFGGNIRAHAFFKHHGWTDGGKVEAKCTSRAGELYRQML

SEQ ID NO: 11478 - protein, 511 aa, Zea mays
  unsure (1)..(511): unsure at all Xaa locations
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGSRANNVIKGTKKEXQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENIMRACVGLAPENNMILEYK

SEQ ID NO: 11479 - protein, 229 aa, Magnolia praecocissima
MARGKIQIKKIDNVTARQVTFSKRRRGLFKKAEELSILCDAEVALIIFSATGKLFEYSSSSMKEIIERHTMHSKNLQKLDQQPSLELQLENSNYNRLSKQVAEKSHLIRQMRGEDIQGLTVEELQKLEKTLETGLSRVMERKAEQIMKEISGLQIKGVKLMEENMRLRQRIIEMSRGDSKGDRQIIESEIVVNEDGQSSDSVTNACNSGAPQDYESSDTSLKLGVPFSS

SEQ ID NO: 11480 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFSAFRPPGCE

SEQ ID NO: 11481 - protein, 508 aa, Pseudomonas fluorescens PfO-1
MNASLTPNETTIQKVKLLIDGEWVESQTTEWHDIVNPATQQVLAKVPFATAAEVDAAVSAAQRAFQTWKLTPIGARMRIMLKLQALIREHSKRIAVVLSAEQGKTIADAEGDIFRGLEVVEHACSIGSLQMGEFAENVAGGVDTYTLRQPIGVCAGITPFNFPAMIPLWMFPMAIACGNTFVLKPSEQDPLSTMLLVELAIEAGIPAGVLNVVHGGKDVVDGLCTHKDIKAVSFVGSTAVGTHVYDLAGKHGKRVQSMMGAKNHAVVLPDANREQALNALVGAGFGAAGQRCMATSVVVLVGAAKQWLPDLKALAQKLKVNAGNEPGTDVGPVISKKAKARILDLIESGIKEGAKLELDGRDISVPGYEKGNFVGPTLFSGVTTDMQIYTQEIFGPVLVVLEVDTLDQAIALVNANPFGNGTGLFTQSGAAARKFQTEIDVGQVGINIPIPVPVPFFSFTGSRGSKLGDLGPYGKQVVQFYTQTKTVTARWFDDDSVNDGVNTTINLR

SEQ ID NO: 11482 - protein, 475 aa, Streptococcus pyogenes MGAS8232
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAVKISNESEYGLQASIFTTNFPKAFGIAEQLEVGTVHLNNKTQRGTDNFPFLGAKKSGAGVQGVKYSIEAMTTVKSVVFDIQ

SEQ ID NO: 11483 - protein, 181 aa, Cytophaga hutchinsonii
MATSEEILEQTIKSTIRDIVDFPEPGIIFKDITPLLKDPQLCKAIVQSITDQLRPLQPDALACLDSRGFWFGLSIAMELGIPMIPIRKKGKLPYETVYEEYALEYGTNTIEMHTDAVQPGCRVAIHDDILATGGTAEATSKLIKKAKGEIIAYSFLIELDFLKGKDKLAPYCTTIQSLINY

SEQ ID NO: 11484 - protein, 376 aa, Populus tremula x Populus tremuloides
MASMYNPETSAVQDQQQNPTLLYDALYCSEENWVEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIEPSLAAEYQSQLLSILGIDKDKVEDCSKFLMEFALRDHFKLLSNKRKFCSLPGSPSGVVDVSFSSDSSNDSWSVASSVSSSPKPLSKKSRALQSLNNATTSDFSQHSSPVP

SEQ ID NO: 11485 - protein, 325 aa, Citrus hybrid cultivar
GNSIQMNDTHPTLCIPELIRILIDLKGLSWKEAWNITQRTVAYTNHTVLPEALEKWSFELMQKLLPRHMEIIEMIDEELVHTIVSEYGTADPDLLEKRLKEMRILENVDLPATFADLFVKTKESTDVVPDDELENCDEEGGPVDEELESEQEDDVLEEEKEAEAVQEPPQLVRMANLCVVGSHAVNGVAEIHSEIVTNEVFNEFYKLWPEKFQNKTNGVTPRRWIRFCNPDLSSILTSWLGTEDWVTNTGKLAELRKFADNEDLQSQFRAAKRNNKMKVVSFIKEKTGYSVSPDAMFDIQVKRIHEYKRQLMNILGIVYRYKKMK

SEQ ID NO: 11486 - protein, 177 aa, Glycine max
MDAKSAVELMESSSEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTKQLLHVMDKLKHGEAVDIPKYDFKSYKSDDVLRRVNPSDVIILEGILVFHDPRVRELMNMKIFVDTEK

SEQ ID NO: 11487 - protein, 260 aa, Oryza sativa
  unsure (1)..(260): unsure at all Xaa locations
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNXAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 11488 - protein, 167 aa, Triticum aestivum
MGSRGQAGPPRQAPVAHPPGAPQSTGGHRTCRHTSILLYSDPQRHRLGPNYLMLPVNAPKCAHHNNHHDGLMNFMHRDEEVNYFPSRFDPTRHAEQYPIPPRVLSGCRGKCIIEKENNFKQAGERYRSFDPARQDRFLQRWVDALTDARVTHELNLFCGGVAMNKKV

SEQ ID NO: 11489 - protein, 312 aa, Escherichia coli
FGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNK

SEQ ID NO: 11490 - protein, 117 aa, Zea mays
  unsure (1)..(117): unsure at all Xaa locations
KKKKKATIDRPENQADRASEKLQAPGDQTPEIDRKSTGAHEGGSPQTXTYPKGFAVKFYTRQGNMDLAGNNMPVVVIRDGMNIPDMGHTLKPNPKTNLQENMKNIKIFFFNHSREPT

SEQ ID NO: 11491 - protein, 454 aa, Magnetococcus sp. MC-1
MNWLIMQRRWGIACVFLSHVNRDRTSQTGDRTMEIIQEHGTIFMFLAIIFGLYMCWGIGANDVANAMGTSVGSGAITVKQAILIAAVFEFAGAFIAGGQVTKTIRKGIIDPAPIANNPELLVYGMLAALLAAAIWLMIASSKGWPVSTTHTIVGAIVGFAVVGIGPDAVKWQKISTVAASWIVSPIVGGGIAYMLMISIRKLILNTDNPFQSARKWGPLYVFMVGFITALVTLWKGLKHLKLDFSMAESFFISALIGLIVAYMGKRMIDKVKLDVEADREYHFASVEKVFMPMMVFTACAMAFAHGSNDVANGIGPLAAVVSIVQSGGEVAQKASLPVWILVLGGVGIVIGLATMGHKVMQTIGTKITELTPTRGYCATLASAVTVVLASKTGMPVSTTQIAVGAVMGVGFARGIGALDMRVIGGIFLSWLVTLPAGGLLAAAIFFIIKGIFGS

SEQ ID NO: 11492 - protein, 704 aa, Bacillus ohbensis
LKNLTVLLKTIPLALLLFILLSLPTAAQADVTNKVNYTRDVIYQIVTDRFSDGDPSNNPTGAIYSQDCSDLHKYCGGDWQGIIDKINDGYLTDLGITAIWISQPVENVYALHPSGYTSYHGYWARDYKRTNPFYGDFSDFDRLMDTAHSNGIKVIMDFTPNHSSPALETDPSYAENGAVYNDGVLIGNYSNDPNNLFHHNGGTDFSSYEDSIYRNLYDLADYDLNNTVMDQYLKESIKLWLDKGIDGIRVDAVKHMSEGWQTSLMSDIYAHEPVFTFGEWFLGSGEVDPQNHHFANESGMSLLDFQFGQTIRDVLMDGSSNWYDFNEMIASTEEDYDEVIDQVTFIDNHDMSRFSFEQSSNRHTDIALAVLLTSRGVPTIYYGTEQYLTGGNDPENRKPMSDFDRTTNSYQIISTLASLRQNNPALGYGNTSERWINSDVYIYERSFGDSVVLTAVNSGDTSYTINNLNTSLPQGQYTDELQQLLDGNEITVNSNGAVDSFQLSANGVSVWQITEEHASPLIGHVGPMMGKHGNTVTITGEGFGDNEGSVLFDSDFSDVLSWSDTKIEVSVPDVTAGHYDISVVNAGDSQSPTYDKFEVLTGDQVSIRFAVNNATTSLGTNLYMVGNVNELGNWDPDQAIGPMFNQVMYQYPTWYYDISVPAEENLEYKFIKKDSSGNVVWESGNNHTYTTPATGTDTVLVDWQ

SEQ ID NO: 11493 - protein, 473 aa, Schizoseris davisii
YESGVIPYAKMGYWDPEYVIKETDVLALFRVTPQPGVDPVEASAAVAGESSTATWTVVWTDLLTACDLYRAKAYKVEPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQSMGIWARKNDMILHLHRAGNSTYSRQKVHGMNFRVICKWMRMAGVDHIHAGTVVGKLEGDPKMIKGFYDTLLEPFLEVNLPEGIFFTQDWASLRKVTPVASGGIHCGQMHQLLDYLGNDVVLQFGGGTIGHPDGIQAGATANRVALESMVIARNEGIDYVKEGPQILRDAAKTCGPLQTALDLWKDITFNYTSTDTADFVETPTANV

SEQ ID NO: 11494 - protein, 394 aa, Zea mays subsp. mays
LGSARRARLPPGEMGWPLVGGMWAFLRAFKSGKPDAFIASFVRRFGRTGVYRSFTFSSPTVLVTTAEGCNQVLMDDDAFVTGWPKATVALVGPRSFVPIPHDEHRRIRKLTAAPINGFDALTGYLPFIDRTVTSSLRAWADHGGSVEFLTELRRMTFKIVVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 11495 - protein, 476 aa, Polypodochrysis teissieri
  unsure (1)..(476): unsure at all Xaa locations
SDRYESGVIPYAKMGYWDDRYPVKDTDVLAMFRITPQPGVDPIEAAAAVAGESSTATWTVVWTDLLTACDVYRAKAFRVEPVPNASDQFFSYIAYECDLFEEGSLPNLTASIIGNVFGFKAVKALRLEDMRIPYAYLKTFQGPATGLVVERERMDKFGRPFLGATVKPKLGLSGKNYGRVVYEGLRGGLDFLKDDENINSQPFMRWRERFLYVMEGVNRAAACSGEVKGSYLNVTAPTMEDMYERSEYAKQVGSIIIMIDLVIGYTAIQSMSVWSRKNDMIXHLHRAGNSTYARQKNHGINFRVICKWMRMXGVDHIHAGTVVGKLEGDPLMVXGFYNTLLLTHMPVNLPQGLFFEMDWASLRKCVPVASGGIHCGQMHQLVHYLGDDCVLQFGGGTIGHPDGIQSGATANRAALEAMILARNEGVDYVQEGPAILQSVARMCRPLQVALDLWKDISFNYTSTDTADFVETATRSI

SEQ ID NO: 11496 - protein, 359 aa, Pirellula sp.
MNSSIVLLPGDGIGPEIVEQARLVLVKVAERFGHTFDFSSHQIGGIAIDETGDPLPQPTIDACRNAAAILLGAVGGPKWDDPSAKTRPEAGLLKIRKELGLFANLRPIKLFDELADASPLRADIVKGTDILFFRELTGGIYFGESGTSGSGEEETAFQSMTYSVGEVKRIVRMAAQAARGRSNRLTSVDKANVLEPSRLWRRVAAEVMANEFPDVQYDVVLVDSMAMHLINRPSEFDVVVTGNMFGDILTDEASMLPGSLGMLPSASLGDGGPGLYEPIHGSAPDIAGKSVANPLATILAAAMMLRHSLGLTDEAEAIEKAVAGVITDGLRTPDLARGDQSKSVSTEEMGAAVVAKLAS

SEQ ID NO: 11497 - protein, 297 aa, Mycobacterium smegmatis
MQLGLIGLGKMGFNMRERLREAGHEVIGYDPRPEVSDVANLEELAGALSAPRVVWVMVPSGTITHSTIVELAGVLSPGDLVIDGGNSRYTEDGPHAELLGEKGISFIDAGVSGGIWGLTEGYGLMVGGSDDDVARAMPIFDALRPPGDVADGFVHAGPVGAGHYAKMVHNGIEYGLMHAYAEGYELLAAEELIKDPQAVIQAWSNGTVVRSWLQSLLAKALKEDPGFAEISGYTEDSGEGRWTVEEAIAHRVPMPVIAASLFARFASRQEDSPTMKAVSALRNQFGGHAVKRISESG

SEQ ID NO: 11498 - protein, 121 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNK

SEQ ID NO: 11499 - protein, 134 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 11500 - protein, 309 aa, Neurospora crassa
MSTTAGAFIAGGIAACGAVTATHPFETVKIRMQLQGELQSSTSSPHFYRGPIHGVSVIVRNEGLGGIYRGIGCAYIYQILLNGCRLGFYEPMRHALATTLFNDAKTQNLGINMFAGAASGIMGAMAGSPFFLAKTRLQSYSPFLPVGTQHQYKNAWDGLTKIYKGEGVKGLYRGVGAAMIRTGFGSSVQLPTYFFAKRRLVKHLGMEEGPALHLASSTASGFVVCVVMHPPDTIMSRLYNQNGNLYKGVFDCLAKTIRAEGFFAIYKGVIPHLTRILPHTILTLSLAEQTTKLVKKLEDKILGPETRVL

SEQ ID NO: 11501 - protein, 521 aa, Zea mays
MPGAVIVHHHTRYKTYPGEVTGIAIFSCFIASVAGCIFGYDIGLTSGLTSTEPFLVKFFPSIYEEMKRQVVVNQYCKFDSQVLTLFSSSLFLAATVATFFAGPMTRAFGRKWTLFAAASAYVVGACIGGVSVNFPMLLTGRVLVGSGVGISIQAAPLYISEVAPAQQRGMLNILFQLMITVGILTANMTNYLASKVSGGWGWRTPVTFGAIPAAVIALGALAIPDTPASLVERGDTATARKTLSQIRGVGDVREEFDDLAAASEDAKAVQCPWRELFFGGKYKPQLTFALLIPFFQQLTGINVIMFYAPVLFKTVGFKQNATLVSSVITGLVNVFSTFVAIATADKIGRRALFLQGGTQMIISQILVGTFIGLQFGMSGTGDISEQYAMCIVLFVCVYVAGFAWSWGPMGWLVPSEIYPLAVRSAAMSVTVAVNMFFTAFIGQIFLTLLCHLRFGLFYFFGAWVLLMTLFIAMLLPETKSVPVEEMAHVWKKHWFWRKFVIDTGNDARNAEMRKRIALEMS

SEQ ID NO: 11502 - protein, 501 aa, Amaranthus hypochondriacus
MAIRVPSRQLFIDGEWREPIKKNRIPIINPSTEEIIGDIPAATAEDVELAVAAARRALKRNKGEDWASASGAHRAKYLRAIAAKITEKKDYFAKLEAMDCGKPLDEAARDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCQKTFGSEDEAIELANDTQYGLGAAVLSKDLDRCERITKALEVGAVWVNCSQPCFTQAPWGGTKRSGFGRELGEWGIENYLNIKQVTRDTSTDEPWGWYKSP

SEQ ID NO: 11503 - protein, 400 aa, ASPERGILLUS NIDULANS FGSC A4
MGSIGNTLAELDASVVKITRSTELRHVPLPGSLEELSHSYCTDHMVTARWTAAGGWETPEVKPFQNLSIPPTASCLHYATECFEGMKVYRGFDGKLRLFRPDLNGERLSNSAVRASLPSFRFQELKTLIAKLMQIDGLRWLPKDQPGRFLYLRPTLIGSGTQLGVQAPAEALLFIIAVPWPDPATRLKATPGEALGLKLLTSAPDTIRAWPGGFGYAKLGANYGPSLAAHGKAQAQGFDQVLWLFGEDRQVTEAGASNFFIVWENAQTGKRELVTAPLENQLILPGVTRRSVLELARSRLNQAVGDLEAVEVVEKTFTIWDVEAAWKEGRVVEAFVCGTAFFITPVKLIRNGAVDIQLLKPGQTAGYAAQIKSWLEAVMYGKDGAENHEWSYIIENESEK

SEQ ID NO: 11504 - protein, 302 aa, Leuconostoc mesenteroides subsp. mesenteroides ATCC 8293
MKIRKNKEEKIMKPVRKAIIPAAGLGTRFLPATKALAKEMLPIVDTPTIEYIVREAIESGIEDIVIVDGKSKRSIEDHFDSNPELENNLREKGKDELLKLVEETTDINMYFIRQSHPKGLGDAVLTAKAFIGDEPFVVLLGDDLMQDEVPLTKQLIQRYEETGESTLAVMKVPHDQVSEYGVIDPAAQVDKGGLYRVKSFVEKPKPEDAPSDLAIIGRYLLTPEIFEELENTKPGKGNEIQLTDAIDSLNNRQHVYAHEFKGSRYDIGSKIGFLETNIEFGLKHPQTKDALRAYIKELASKL

SEQ ID NO: 11505 - protein, 241 aa, Petunia x hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 11506 - protein, 530 aa, Streptomyces coelicolor A3(2)
MDVMPLLLLVAGSAAVAAAGRRVPVPVPLLLVAAGLAVSYVPGVPDYTLDPHIVLPLLLPPLLYTAATDSSYLDLRAQARPVALLSVGYVLFATFVVGCAAYLIVPGLPLTAALVLGAVVAPPDAVAATAVARRVGLPSRITTILQGESLVNDATAITAFKVALAAAVGEGATWAGGIGEFLIAAVGGVGVGLVLMVPLHWLRTHLTEALLQNTLSLLIPFVAYAVAEQVQASGVLAVVVVALYLGHRAWEVDFATRLQEEAVWKMVAFVLESAVFALIGLQLPVVLKGLGEYEGADAAWYALAVFLVVAVARFVWVYPATYLPRLSARVRAREGELSWKGPFVIGWAGMRGVVSLAIAFSIPLTVHGGEPFPERNLILFLTFTTVIGTLVVQGVSLPPLIRLLKFPAHDVQAETLAEANAQAQASRVAELRLDDLLADERNALPAPLADRLRMVLERRRNAVWERLGQVNPVTGETVDDTYRRLSREMISAEREVFVRLRDGRYIDDEMLRTLLRRLDLEEAAAYREAT

SEQ ID NO: 11507 - protein, 196 aa, Yersinia intermedia
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 11508 - protein, 614 aa, Arabidopsis thaliana
MASLSFTQFLSFPRCNADVPCLLQSHGFVKFRGERWNGKQSFSMAAGRRKLSESAPLEEEGNDGNGAVVGKKPSKSVKRTTKKKVVVKDEPLEEISEFLVDNDDVLDKESIVSALKPKKTRTRKKAAAASSDVEEVKTEKKVRRKRTVKKDKDVEDDLATIMDAEVSDVEEALAVESTDTESEEEEIDLSKHEGEDISHTYGWPPLVCCFGSAQHAFVPSGRPANRLLDYELHERMRDAKWAPEKYIRAPGGCAGGVAIALASLGGKVAFMGKLGADDYGQAMLYYLNVCKVQTRSVKIDGKRVTACSTMKISKRGRLKSTCIKPCAEDSLSKSEINVDVLKEAKMFYFSTHSLLDKKMMSTTIQAIKISKQLGNVIFYDLNLPLPLWHSSEETKSFIQEVWNLADVIEITKQELEFLCGIEPTEEFDTENNDISKFVHYPPETVEQLWHENLKVLFVTNGTSKIHYYTKEHNGAVSGMEDVPITPFTRDMSASGDGIVAGLIRMLTVQPDLMNNKGYLERTARYAIECGIIDQWLLAQTRGYPPKDDMEEEEDDEEEDEVESDPNGIRSITEKEYRTSKPYDEPDGPYVMKPVEEREYKKLELVGSMFEDGSL

SEQ ID NO: 11509 - protein, 758 aa, Glycyrrhiza glabra
MWKLKIGEGGAGLISVNNFIGRQHWEFDPNAGTPQEHAEIERLRREFTKNRFSIKQSADLLMRMQLRKENHYGTNNNIPAAVKLSDAENITVEALVTTITRAISFYSSIQAHDGHWPAESAGPLFFLQPLVMALYITGSLDDVLGPEHKKEIVRYLYNHQNEDGGWGFHIEGHSTMFGSALSYVALRILGEGPQDKAMAKGRKWILDHGGLVAIPSWGKFWVTVLGAYEWSGCNPLPPELWLLPKFAPFHPGKMLCYCRLVYMPMSYLYGKKFVGPITALIRSLREELYNEPYNQINWNTARNTVAKEDLYYPHPLIQDMLWGFLYHVGERFLNCWPFSMLRRKALEIAINHVHYEDENSRYLCIGSVEKVLCLIARWVEDPNSEAYKLHLARIPDYFWLAEDGLKIQSFGCQMWDAAFAIQAILACNVSEEYGPTLRKAHHFVKASQVRENPSGDFNAMYRHISKGAWTFSMHDHGWQVSDCTAEGLKAALLLSEMPSELVGGKMETERFYDAVNVILSLQSSNGGFPAWEPQKAYRWLEKFNPTEFFEDTMIEREYVECTGSAMQGLALFRKQFPQHRSKEIDRCIAKAIRYIENMQNPDGSWYGCWGICYTYGTWFAVEGLTACGKNCHNSLSLRKACQFLLSKQLPNAGWGESYLSSQNKVYTNLEGNRANLVQSSWALLSLTHAGQAEIDPTPIHRGMKLLINSQMEDGDFPQQEITGVFMRNCTLNYSSYRNIFPIWAMGEYRRQVLCAHSY

SEQ ID NO: 11510 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRVIISGRGDEVIELAKTNWLR

SEQ ID NO: 11511 - protein, 170 aa, Zea mays
  unsure (1)..(170): unsure at all Xaa locations
MDGRMFGLETPLMVALQHLLDVPDGDAGAGGDKASGAAAGGGPTRTYVRDARAMAATPADVKGAPGRVXAFVVDMPGLGTGDIKVQVEDERVLVISGERRREEREDAKYLRMERRMGKFMRKFVLPDNADMDKISAVCRDGVLTVTVEKLPPPEPKKPKTIEVKVRLRWD

SEQ ID NO: 11512 - protein, 339 aa, Novosphingobium aromaticivorans
MPNGAFPRMSDPLYDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQRLG

SEQ ID NO: 11513 - protein, 312 aa, Photobacterium profundum
MKVAVIGAAGGIGQALALLLKNGLPAGSDLALYDIAPVTPGVAADLSHIPTPVSIKGYGGVDPTPALEGADVVLISAGVARKPGMDRSDLFNVNAGIIKSLAEKIAVVCPKACVGIITNPVNTTVAIAADVLKKAGVYDKRRLFGITTLDIIRSETFVAELKGKTPSELQVPVIGGHSGVTILPLLSQVEGVEFSDEEIKALTPRIQNAGTEVVEAKRGGGSATLSMGQAAYRFGLSLVRALQGQQGIVECAYVEGDGKHARFFAQPVLLGKDGVEEVIDYGKLSTFEQEALNNMLDTLTSDITLGEEFAAK

SEQ ID NO: 11514 - protein, 428 aa, Streptomyces avermitilis MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 11515 - protein, 367 aa, Chloroflexus aurantiacus
MAEMLRESPYPMVSIAEATATIMAQARPLASEEIEAFSALGRVLAGDITSPEDIPDVPKSAMDGYALRAADGLTPRRVVGELTAGGAAAVMLAPGEATRIMTGAPLPPGADAMIPVELTTERDGMLYIQRELQPGDYVHVVGQDVRRGQTVLTAGTTIGAAEIGILATLGITRIPVYRQPRVAILATGDEVVEPGSPRPAGAVRDSNRYALMAAVREAGGIPISLGIARDDRDVQRQAILHGLDQADVLITSGGVSMGTRDLIKPLLAELGTVHFGRIAFKPGKPTTFATIGGKLVFGLPGYPVSSLVSFEVFVRPALRALQGDASPFRPQIEVTVAEPVRPSPDRPEYQRIIVRYQEGRFTRSHNR

SEQ ID NO: 11516 - protein, 161 aa, Glycine max
GDLSNVGLRNVLARPSVGSERIPDLLYCVYQGMFACITVALASGAVSERGRMLPCVVFMFIWTTVVYDPLACWTWNPAGWSYRLGGLDFAGGTPVHIASGSAALAYSYILGKRAGHGTHALNYRPHNITFIVIGTVFLWVGWFGFNAGSALSANLRAVMAA

SEQ ID NO: 11517 - protein, 486 aa, Saccharomyces cerevisiae
MVHLGPKKPQARKGSMADVPKELMQQIENFEKNFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIHIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVSTRYPGFKEKAANALKDIYGWTQPHLDDYPIKVVPAEDGSGPGAAVIAALAQKRIAEGKSVGIIGA

SEQ ID NO: 11518 - protein, 236 aa, Heuchera americana
VQLRRMENKINRQVTFSKRRGGLVKKAHEISVLCDVEVALIVFSNKGKLFEYSTDSCMEKILERYERYSYAERRLVATGSESQENWSLEYTKLKAKIELLQRSQRQFMGEDLDLLSLRELQNLEQQLDTALKHIRSRKNQLMNQSISDLQKKEKAIQEQNNLLAKKIKEKEKAMSQQAEWEQQNNGASTSNFLNPQPLPCLNISSTYQGGAQPEAMRRNELDLTLEPIYSCHLGCF

SEQ ID NO: 11519 - protein, 501 aa, Matricaria chamomilla
MKPLFSLFLSLLILAQSSSSLPLPQTILPSTQASSLIRGLNLFPKHAVNLVEEDDYVRNNNSLDKKIVEKLFRFPNFVESDGVTVEDLGHHAGYYQIQHSHAAKMFYFFFESRNNKKDPVVIWLTGGPGCSSELALFYENGPFKIADNMTLVWNEYGWDQASNLIYVDQPTGTGFSYSSDKRDIRHDEQGVSDDLYDFLQAFFTEHPEFVDNDFYITGESYAGHYIPAIAARVHQGNKAKEGIHINLKGFGIGNGLTDPAIQYQAYTDYALDMGLIKESQYKRINLIVPLCEAAIKLCGTDGTVSCMAAYVVCNTIFSSILSIAGNINYYDIRKECVTSMCYDFSDMETLLNKKSVRQALGVGDIEFVSCSTTVYTAMLVDLMRNLEAGIPELLEDGIKMLVYAGEYDVICNWLGNSRWVHAMEWNGKEQFNALSEAPFEVDGSEAGLLKSYGPLSFLKVHDAGHMVPMDQPKAALEMLKRWMDGSLSETPRGPKSLVSSI

SEQ ID NO: 11520 - protein, 175 aa, Novosphingobium aromaticivorans
MAIDPSREFKPINIALLTVSDTRGPDEDTSGDILAERIRAKGHKLAARAMEKDDADRIVSRLNNWVDDRSVDAVIITGGTGLTGRDVTPEALDRVKTREIPGFGELFRWLSYKTIGTSTIQSRACAVVARGTYIFALPGSNGAVKDGWDGILDEQLDSRNRPCNFVELMPRLLEK

SEQ ID NO: 11521 - protein, 290 aa, Vibrio parahaemolyticus RIMD 2210633
MIKKCLFPAAGYGTRFLPATKSMPKEMMPVVNKPLIEYGVEEAIQAGMNGMCIVTGRGKHSIMDHFDKNYELEHQISGTNKEELLVDIREIIESANFTYIRQREMKGLGHAILTGRELVGDEPFAVVLADDLCVNEEEGVLAQMVALFKQFRCSIVAVQEVPADETHKYGVISGEMIKDDIYRVDDMVEKPEPGTAPSNLAIIGRYILTPDIFELIENTEPGKGGEIQITDALLKQAKAGCVLAYKFKGKRFDCGSVEGYIEATNYCFENLYLKDEKKSELGKHATKKEV

SEQ ID NO: 11522 - protein, 319 aa, Klebsiella pneumoniae
MLSKQALLQAYRKMREIRTFEERLHQENTSGDIPGFIHLYTGEEAIAVGVCENLTSADFIGSTHRGHGHCIAKGCDIHGMMAEIFGKDSGLCRGKGGSMHIADLSKGMLGANAIVGGAPPLAIGAALTAKTLKTGNVGVSFTGDGGSNQGLVFEAINMAVVLQLPAVFIFENNGYGEGTGHDYAVGGRDIARRAAGFGLPAVTVDGTDFFAVYEATSEAVKRAREGGGPSVIEAKAFRWHGHFEGDPALYRAEGEVQRLREQHDPLKIFTAKVKQHITQEELAAIDEEVEALVNDAVLKARAAAYPAPEDLLTDVYVSY

SEQ ID NO: 11523 - protein, 257 aa, Arabidopsis thaliana
MGRSPCCEKAHMNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 11524 - protein, 500 aa, Atriplex prostrata
MAFPIPVRQLFIDGEWREPLLKNRIPIINPSTEEIIGDIPAATAEDVEVAVVAARKAFKRNKGRDWAATSGAHRAKYLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 11525 - protein, 468 aa, Nitrosomonas europaea ATCC 19718
MAADVLKMIQDHEVKFVDLRFTDTNGKEHHVTVPAHTFDTDKFEDGHAFDGSSIAGWKNIHASDMLLMPDPETAALDPFMEETTLLLTCDVVDPADGQGYNRDPRSLAKRGETYLKSTGIGDIAYFGPELEFFIFDSVRWHTDMSGCFVKIESEEAAWSSKKRYEKSNNGYRPAVKGGYMPVPPVDSLHDIRSAMCMVLDELGIPVEVHHHEVANAGQCEIGTRFSSLVKRADWNQLMKYVIHNIAVSYGKTATFMPKPIVGDNGSGMHVHQSIWKEGKNLFAGNGYAGMSETALYYIGGIIRHAKALNAFANPGTNSYKRLVAGFEAPVNIAYSASNRSAAVRIPYASSPKQRRIEIRFPDPSANPYLTFTALLMAGLDGIQNKIHPGDPMDKNLYDLPPEEASMVPNTCASLEEALASLDSDREFLTRGNVFSNDMIDAFIKLKSEEATLLRTTTHPVEFALYYSL

SEQ ID NO: 11526 - protein, 483 aa, Bacillus cereus ATCC 14579
MDKKATFVSIDKKAMYINGEWITLQEQIEVNNPATKEIFATVPKGGVTEAKQAVDAAHEAFKTWSKLTAADRATKLKKWFTLIDENKEEIAAIMTKEQGKPFAEALGEVNYANSFVEWYAEEGKRVYGEMIPAAHPNKRILVMKQPVGVMAAITPWNFPAAMITRKVAPALAAGCTAVVKPASQTPLTALKLAELAHEADIPKGVINIITGSAKAIADTWMEDGRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGLANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 11527 - protein, 428 aa, Medicago sativa
MKFSEENNVSNNPTNFEGGLDSRKVGQNRRALGVINQNLVVEGRPYPCVVNKRALSERNDVCEKKQADPVHRPITRRFAAKIANTKTTNAEGTTKRSNLAKSSSNGFGDFIFVDDEHKPVEDQPVPMALEQTEPMHSESDRMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 11528 - protein, 407 aa, Glycine max
  unsure (1)..(407): unsure at all Xaa locations
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKXLGIDLVIEGTGVFVDREGAGKHIQAGAXKKVLXTAPGKGDIPTYVVGVNEYDYSPDEPIISNASCTTNCLAPFVKVLDQKFGIIKGTXMTTTHSYTGXQRLLDXASHRDLRRARAAALNIGPHFNRSRQRQWALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 11529 - protein, 552 aa, ASPERGILLUS NIDULANS FGSC A4
MKILPSLRLAYIMTVLSVLNISNAATTAEWKARSIYQTMTDRFARTDGSTTHACNTTAGLYCGGTWRGTINHLDYIQGMGFDAVMISPIIENIGGRVSYGEAYHGYWPLDLYSLNDHFGTHQDLLDLSAALHERGMYLMMDTVINNMAYMTDGDDPAKNIDYSALTPFNKSEYYHPYCKIKDWNDYHDAQWCQTGDNKVALPDLYTERKDVQDTLISWAKGIVKTYSIDGLRIDAAKHVNTGFLKTFSDSVDMYVTGEVLQREVDIICNYTENYIDSVPNYPIYYSMLDAFTQGNTTSLYHQVENMKKSCRDVTTLVSFSENHDVARVPSFNDDMALAKNILTFTILFDGIPMIYQGQEQHLSGDGTPKNRQAVWLSAYNTDSELYKLIATLNKIRKHVISLGSDYLDEQTVPLYRGGSELAFSKGVEGRQIIMLLSGQGSKGDPYTLTLPVSYNAGTTVTDVLHCVNYTSVGSGERAGELDVPMSKGEPRVFFPADLMEGSGLCGHAGGNVSLAKLETGKDRVVSGGRIVGEANATLVMIMSVLAGVLLLA

SEQ ID NO: 11530 - protein, 503 aa, Hordeum vulgare subsp. vulgare
MVAPAKIPQRQLFIDGEWRAPALGRRLPVINPTTEVSIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEVGLPSGVLNIVTGLGNEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKTEGATILTGGVRPKHLEKGFFIEPTIITDINTSMEIWREEVFGPVLCVKEFSTEEEAIELANDTHYGLAGAVISGDRERCQRLAEEIEAGCIWVNCSQPCFCQAPWGGNKRSGFGRELGEGGIDNYLSIKQVTEYTSDAPWGWYKAPAN

SEQ ID NO: 11531 - protein, 517 aa, Candida tropicalis
MIEQILEYWYIVVPVLYIIKQLIAYSKTRVLMKQLGAAPITNQLYDNVFGIVNGWKALQFKKEGRAQEYNDHKFDSSKNPSVGTYVSILFGTKIVVTKDPENIKAILATQFGDFSLGKRHALFKPLLGDGIFTLDGEGWKHSRSMLRPQFAREQVAHVTSLEPHFQLLKKHILKHKGEYFDIQELFFRFTVDSATEFLFGESVHSLKDETIGINQDDIDFAGRKDFAESFNKAQEYLSIRILVQTFYWLINNKEFRDCTKSVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAFLNETLRVYPSVPRNFRIATKNTTLPRGGGPDGTQPILIQKGEGVSYGINSTHLDPVYYGPDAAEFRPERWFEPSTRKLGWAYLPFNGGPRICLGQQFALTEAGYVLVRLVQEFSHIRSDPDEVYPPKRLTNLTMCLQDGAIVKFD

SEQ ID NO: 11532 - protein, 332 aa, Neisseria meningitidis MC58
MSRPVPAVFGSVFHSQMPVLAYREGKWQPTEWQSSQDLSLAPGAHALHYGSECFEGLKAFRQADGKIVLFRPTANIARMRQSADILHLPRPETEAYLDALIKLVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 11533 - protein, 221 aa, Abies holophylla
YTYNLRNKGPEDVILRVIYCGICHSDLVQMRNEMGMSNYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESL

SEQ ID NO: 11534 - protein, 286 aa, Triticum aestivum
  unsure (1)..(286): unsure at all Xaa locations
MSFSVAGMEKERGAAAAVEEIRRLPAEVNWEMLDKSRFFVLGAALFSGVSAALYPAVVVKTHLQVAPPPQAAAHTEGAMARRDGLXRGFYRGFGASLAGTVPARALXMAALEATKSSVGXASAAAGVSAAVAAQVVWTPVDVISQRLMVQTSAACRYAGGADAFRKILAADGGRGLYRGFGLSIITYAPSNAVWWASYAMAQRFAWRVVGADRSESYPALMAVQGASAFLAVXGGAAALVTMPLDTVKTRLQVMETDAAVARPTLGSTVRCLLKEGGGAPCYRGLG

SEQ ID NO: 11535 - protein, 220 aa, Zea mays
  unsure (1)..(220): unsure at all Xaa locations
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNTRIMLVGNKTDLRHLRAVATDDARSFAEAEGLSYIETSALEATNVXEEAFQLILGDIYRAVSKKPVASDEVGAGQGGVKEGKTIDVATGADAAAHKKQCCSA

SEQ ID NO: 11536 - protein, 263 aa, Arabidopsis thaliana
MLGLQSYWDAAYSDELTNFREHGHAGEVWFGDDVMEIVTSWTKDLCVEISQRNMSVSENDVTTEVNDQADKYLSSWNVLDLGTGNGLLLHQLAKEGFSDLTGTDYSDGAVELAQHLSQRDGFPNIRFMVDDILDTKLEQQFKLVMDKGTLDAIGLHPDGPVKRVMYWDSVSKLVAPGGILVITSCNHTKDELVEEVENFNIRKSNLCRGDGNDANNVLSSGSEAASRIDQPPFEYLSHVRTYPTFMFSGSVGSRVATVAFLRK

SEQ ID NO: 11537 - protein, 282 aa, Triticum aestivum
  unsure (1)..(282): unsure at all Xaa locations
AIKIVRSLQKYREAAMIEIDVLQRLGKHDFRXGRVGKKKKKKKKKKKKKKKIEKKKKNLYEKKGKNSCRSFPIDLVREFARQILESVTFMHDLRLIHTDLKPENILLVSPDTIRVHDYKIPIRPPKDGSVFKNLPKSSAIKLIDFGSTTFDHQDHNYVVSTRHYRAPKVILGLGWNYPCDLCRVGCILIDLCSREALFQTHENLEHLAMMKNVLCPLPKHMIARADRRAEKYFRRGLMLDCPEGAASLESMKAGWKLPHLQNLDMQHVXHSDWDLIDLLPRA

SEQ ID NO: 11538 - protein, 411 aa, Escherichia coli K12
MEFTTGLMSLDTALNEMLSRVTPLTAQETLPLVQCFGRILASDVVSPLDVPGFDNSAMDGYAVRLADIASGQPLPVAGKSFAGQPYHGEWPAGTCIRIMTGAPVPEGCEAVVMQEQTEQMDNGVRFTAEVRSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERDRGNVEVGEWVEVEPFNALFGGL

SEQ ID NO: 11539 - protein, 323 aa, Triticum aestivum
  unsure (1)..(323): unsure at all Xaa locations
MKTSSSSQALFPAASSLCTPYLLLVPLGLLAAVVVIPSLGSSHVRSDGLGVLCPSLGTDGYSVASGAEKVVSTAAAAAQPEFRLLVGVLTTPKRRERRDIVRLAYALQPPVPAYARVDVRFVFCGVDDPVDRMLVALEAARHGDVLLLNCTENMNDGKTHQYFSSVPRVXAGAPYDYVMKTDDDTYLRVAAMAEELRPKPRDDVYLGYGFAVGDDPMQFMHGMGYVVSWDVATWVSANEEILRHNDTHGPEGLLFGKWLNIGRRGKNRYSLRPRMYDLNWDMDNFRPDTVAVHMIKDNRRWAAAFRYFNVTAGIRPSNLYHLP

SEQ ID NO: 11540 - protein, 337 aa, Phaeosphaeria avenaria f. sp. triticae
MVVKVGINGFGRIGRIVFRNAIEHNDVEIVAVNDPFIEPHYAAYMLKYDSQHGQFKGDIKVDGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAIKAAADGPLNGILGYTEDEIVSTDLNGDTRSSIFDAKAGISLNKNFVKLVSWYDNEWGYSRRVLDLLVYIAKVDGNA

SEQ ID NO: 11541 - protein, 488 aa, Bacillus anthracis str. A2012
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 11542 - protein, 431 aa, Rhizobium etli
MNVLRKETSQPPASVSIIGAGGICDLIGNSVLDFHRIQRLPPYVFEQVNRLKASARAGGADIIDLGMGNPDLPTPQSIVDKLCEVVQDPRTHRYSSSKGIPGLRRAQAAYYARRFGVKLNPDTQVVATLGSKEGFANMAQAITAPGDVILCPNPTYPIHAFGFLMAGGVIRSMSVEPDESFFPPLERAVRHSIPKPLALILNYPSNPTALVATLDFYKDVVAFAKKHDIIVLSDLAYSEIYFDGAPPPSVLEVPGAMDVTVEFTSMSKTFSMPGWRMGFAVGNERLIAALTRVKSYLDYGAFTPIQVAATHALNGDGSDIAEVRNVYKRRRDVMVESFGKAGFDVPPPAATMFAWAKIPEKFRHLGSLEFSKLLVEKADVAVAPGIGFGEMGDDYVRLALVENEHRIRQAARNIKRWLSGDEKFEINVMNQ

SEQ ID NO: 11543 - protein, 678 aa, Eremothecium gossypii
MRRARANEGERRGPAAAEQFERPRTHARSGSSNRKHMICVQDRCVRVGSSAQVRLARGRCLCHLNSCAARTGAAAPRDRGAVLFRKVRGQLRAQPSSSPSHGAGAPCRAAVYRRVRAGLTGLRPPAVVMSRRASTLGGSVPTSRGTEAAMVDIVSWHLVADPASSLQLQGGDITRELYRWTAERPGRRRSHSYGGSRAPSVHSMGARDMRAPNGFRRSYMMERGGVLTGSFMEFLSLYGHFAGEDLSEDEDDALADAAVLFEEEETLLQGRRRSYGTDSGEAGGASVFRTVLLLLKSSVGTGVLFLPKGFHNGGWLFSTGALVFCGAASCVCFMLLIAAKEQEGVGGYGDLGRRVCGVAMQRTVLASIVLSQLGFAAVYAVFTATNLQVVCSTLFGWHASTGVYVAAQAAVYLPLALTRRITKLSATALLADLFILLGLVYVYYFSASQVVQHGAATDSMLAFNPSSWTVFLGTAIFTYEGVGLLIPIQESMRSPEKFRRCLLWVMVAVTAVFISFGMLCYAAFGAKVETVILLNFPQDSALGTGVQLLYAAAIMLSTPLQLFPAIRILENVVVTTSRSGKYSTKVKWIKNWFRALVVVLMLVLASLGSNDLDKFVSLIGSFACIPLIYVYPPLLHYVVFRGTGTVSQVALALDLAVMAFGLGIMGYTTVQTVVQWYG

SEQ ID NO: 11544 - protein, 136 aa, Triticum aestivum
TPSKGRNLYFKNENGGFATYELQRSYAWLELINPAETFGDIVIDYPYVECTSAAIQALTSFKKLYPGHRRKDVDNCINKAASYIESIQRKDGSWYGSWAVCFTYGTWFGVKGLPAPAGTFWCSPPIWKARHPLFSP

SEQ ID NO: 11545 - protein, 407 aa, Rhodospirillum rubrum
MRGWVLPDHAPGMPCGLGPGCYTAADWPSAVTGAGRMVERRIPTLRQPQRPPRQSRQRSIDQSRPRSPKRESDVTSMHEPRFDVAGIGNAIVDVLSHADDAFLATNDLPKGGMTLIDETRAEVLYASMGPGIEASGGSAANTMAGLASLGARTAFIGKVRDDALGAIFRHDITSIGVTFPTAPLTEGPSTARCLILVTPDAERTMNTYLGACTQLAPDDIDAEVIADSAITYIEGYLWDQPAAKTAILQAAAQARKAGRKVALSLSDSFCVDRHRDTFLELVDNHVDILLANEHEVMALFGSADLDQATAALRGRCALAVVTRSAKGCRIVSAESVTDVPAETVDHLVDTTGAGDQFAAGFLFGLCRGYEPKLCARIGAIAAAEVVSHFGARPEAASLADLVKAKLG

SEQ ID NO: 11546 - protein, 126 aa, Zea mays
MANEGVAAERAVKAPPPETESIVWREDKGRFQTPDGEAFLQYRLLDGRGAPAAAVMDLVHTYVPRSKRGQGLAARLCDAAFAHAQARGMRVLPTCSYISDTYLPRNPALKELVDKDQEPHPKPSSM

SEQ ID NO: 11547 - protein, 70 aa, Glycine max
  unsure (1)..(70): unsure at all Xaa locations
INSWGKGLQAVSDSLLLYNTTRVLRSNXSGXFLSLCXAFIEAXYPHCATCXGRCXLGGATLIMRMWISRY

SEQ ID NO: 11548 - protein, 466 aa, Glycine max
  unsure (1)..(466): unsure at all Xaa locations
MANTLYNGATCRIPLRDESLAFSRHVSRSLSFLLKTRAGKQSYAFAVKASSHSDFDVDLSLSPRVNAVKPSKTVAISDHATALFQAGVPVIRLAAGEPDFDTPAPIAEAGINAIREGYTRYTPNAGTMELRQAICRKLKEENGISYTPDQVVVSNGAKQSXWLQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATXHTSFASLPGMWDRTLTVNGFSKAFAMTGWRLGYIAGPKHXVAACGKIQSQFTSGASSIAQKAAVAALGLGHAGGEAVSTMVKAFRERRDFLVKSFREIDGVKISEPQGAFYLFLDFSFYYGREAEGFGKIEDSESLCQYLLDVGQVALVPGSAFGDDTCIRISYAESLTTLQAAVERVKRALIPLSSAALV

SEQ ID NO: 11549 - protein, 647 aa, Lipomyces starkeyi
MLLINFFIAVLGVISLSPIVVARYILRRDCTTVTVLSSPESVTSSNHVQLASHEMCDSTLSASLYIYNDDYDKIVTLYYLTSSGTTGSVTASYSSSLSNNWELWSLSAPAADAVEITGASYVDSDASATYATSFDIPLTTTTTSSSSASATSTSSLTTTSSVSISVSVPTGTAANWRGRAIYQIVTDRFARTDGSTTYLCDVTDRVYCGGSYQGIINMLDYIQGMGFTAIWISPIVENIPDDTGYGYAYHGYWMKDIFALNTNFGTADDLIALATELHNRGMYLMVDIVVNHFAFSGSHADVDYSEYFPYSSQDYFHSFCWITDYSNQTNVEQCWLGDDTVPLVDVNTQLDTVKSEYQSWVQELIANYSIDGLRIDTVKHVQMDFWAPFQEAAGIYAVGEVFDGDPSYTCPYQENLDGVLNYPVYYPVVSAFESVSGSVSSLVDMIDTLKSECTDTTLLGSFLENQDNPRFPSYTSDESLIKNAIAFTMLSDGIPIIYYGQEQGLNGGNDPYNREALWLTGYSTTSTFYKYIASLNQIRNQAIYKDDTYLTYQNWVIYSDSTTIAMRKGFTGNQIITVLSNLGTSGSSYTLTLSNTGYTASSVVYEILTCTAVTVDSSGNLAVPMSSGLPKVFYQESQLVGSGICSM

SEQ ID NO: 11550 - protein, 327 aa, Glycine max
MTGSADPLVISFGEMLIDFVPDTSGVSLAESCAFIKAPGGAPANVACAISKLGGNAAFVGKMGDDEFGRMLVDILRKNGVNTDGVCFDTEARTALAFVTLRKDGEREFMFYRNPSADMLLKESELNMGLIKQAKVFHYGSISLISEPCRSAHLAAMKVAREGGALLSYDPNVRLPLWPSEEAARSGIKSIWFDADFIKVSDDEVHFLTQGDPEKEDVVMTLWHDKLKMLLVTDGEKGCRYFTKNFRGRVTGFSAKVVDTTGAGDSFVGALLTAVARDPNIFHNEPKLREALTFANACGAMCTTQKGAIPALPTAAEAEKFISNSKAK

SEQ ID NO: 11551 - protein, 263 aa, Torenia fournieri
FFELLNHGISPEFMDTVERLTKDHYKKCMELRFKEMVASKGLEAVQSQADDIDWESTFYVKHLPESNISEIPDLDDDYRKVMKEFAAQIEKLAEELLDLLCENLGLEKGYLKKVFYGSKGPPFGTKVSNYPPCPKPDFIKGLRAHTDAGGIILLFQDDKVSGLQLLKDGEWVDVPPMKHSIVINLGDQLEVITNGKYKSVMHRVIAQTDGNRMSIASFYNPGTDAVIYSAPALVEKEEEKKDLYPKFVFDDYMKLYAGLKFQA

SEQ ID NO: 11552 - protein, 558 aa, Haemophilus somnus 129PT
MNGANLVVECLKAHGVTSLFGYPGGAIMPVYDAIYDSGLDHLLCRNEQGAAMAAIGYARSTNKVGVCVATSGPGATNLITGLGDALMDSIPIIAITGQVASNFIGTDAFQEADILGLSLACTKHSFIVQHIDELPEIIAKAFQIAQSGRPGPVLIDLPKDVQFAPTSLKPIVYPKIADSLQNLVALEQAKNLLSQAKRPVLYVGGGVGMAKSSDGMSGVKAIRTFLDITNIPSVSTLKGLGTIPPKHPLYMGMIGMHGTKAANYAVQECDLLIACGARFDDRVTGKLDTFAPHAKVIHIDIDVAEINKLRKADVGLQGDLVEAITNLAQLLDIEPWRKDIEQLKASFDFNYIENTEDKEIEPCALLHTLSERKAKNAVITTDVGQHQMWSAQHMKHYEPENYITSAGFGSMGFGLPAAIGAAKARPQDPVILITGDGSLMMNIQELGSIKRGNLPIKILLLDNQRLGMVRQWQSLFFHGRHSHTVLDDNPDFVTLASAFGIAGERIEKVSEVSDALDRLLNAKEAYLLHVCIPDEENVWPLVPPNTCNSNMIEEDIGV

SEQ ID NO: 11553 - protein, 180 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMSIAAVAGIESYVLEYGMDCLEMHVGAIEPGERVVVVDDLVATGGTLSAAIRLLERAGANVVECACLIGLPKFKDFYKLNGKPVYILVESRK

SEQ ID NO: 11554 - protein, 441 aa, Porphyra suborbiculata
  unsure (1)..(441): unsure at all Xaa locations
PQPGVDPIEASAAIAGESSTATWTVVWTDLLTACDLYRAKRYRVDPVPNVADQYFAYIAYDIDLFEEGLYANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASAAAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGVDVVLQFGGGTIGHPDGIQAGATANRVALESMVMXXXXERNYVAEGPQILRDAAKTCGPLQTALDLWKDISFNYTSTDTADFVETPTANI

SEQ ID NO: 11555 - protein, 115 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISR

SEQ ID NO: 11556 - protein, 377 aa, Brucella suis 1330
MAQPRLTPLVESLPSTVPFIGPETLELQRGKPFKARIGANESSFGPAPSVIEAMRNEATEVWKYGDPENYALRHAIAAHHGLKAEHIMPGAGVDALLGLIVRQYVQQGDKVINSLGGYPTFNYHVAGYGGQLVTVPYRDDKPDLDALIDAAAREKPALLYIANPDNPMGTWHEGADIQSFIERLPETTLLILDEAYCETAPASAFPPFETDRPNVLRMRTFSKAYGLAGIRCGYAVGNPVAIKTFDKVRDHFAVSRMAQAAAIAALKDQAYLHEVVGKICAGRDRIAAIAEANGLHAVASATNFVAIDCGRGKDFAQAVLNGLISRDIFVRKPGTPVLDRCIRVSVGVKEQLDQFEAAFPEALEEARKICAANAENT

SEQ ID NO: 11557 - protein, 428 aa, Pseudomonas syringae pv. tomato str. DC3000 [sequence omitted]

SEQ ID NO: 11558 - protein, 341 aa, GIBBERELLA ZEAE PH-1
MPQQLIGSEYTVYRSGDGNGGFTPTTVKVTTLGPHDILVRITHSGVCHTDITFCQMGAPIALGHEGVGIVEAVGSLVTQFNVGDRAGGGFHRDACGHCKYCLSGKDIYCYNRVIFGEGDFDNGTFGKYYIGKETYLHKIPEGLASEHAAPLQCAGATVYAALKATVTPEKRVGILGIGGLGHLAIQYANKMGADVIIYSTSTSKETEARQLGAKEFHLLDNMFDDVKAPIDVLVICGTKYPDWDRVMAKEFLARDGVIVPLAAPVHGPLSLPAGAMFFQGYHVFSSLVGSRNVHDEMLEFSARHGIKPMVQIFKHEGAETIREVFELVQMNKMRYRAVLEM

SEQ ID NO: 11559 - protein, 390 aa, Oryza sativa
MAAAILLRRVPPARAQATALIAARSISDSTAPLTIETSVPFTSHIVDPPSRDVTTTPAELLTFFRDMSVMRRMEIAADSLYKAKLIRGFCHLYDGQEAVAVGMEAAITRSDSIITAYRDHCTYLARGGDLVSAFAELMGRQAGCSRGKGGSMHFYKKDANFYGGHGIVGAQVPLGCGLAFAQKYRKEETATFALYGDGAANQGQLFEALNISALWKLPAILVCENNHYGMGTAEWRAAKSPAYYKRGDYVPGLKVDGMDVLAVKQACKFAKEHAIANGPIVLEMDTYRYHGHSMSDPGSTYRTRDEISGVRQERDPIERVRKLILAHDLATAAELKDMEKEIRKEVDDAIAKAKESPMPDTSELFTNVYVKGFGVESFGADRKELRATLP

SEQ ID NO: 11560 - protein, 110 aa, Rickettsia sibirica
MTEVESLHKTSSTKNHSVESQMFQNEEKALPVYTVLVPLYKEFSKLRSIIKNISLINYPKDKLGVKIIIEDDDYLMIKEIVLYNLPSYFHVISVPKSLPRTKSRKPLIML

SEQ ID NO: 11561 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 11562 - protein, 540 aa, Zea mays subsp. mays
MGLGVDAETVRLGVLSSTSDHASVVSNNFFVALLCACIVLGHLLEENRMVNESITALLVGLGTGTVILMISRGVSIHVLVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSIVVFNALQNFDITHINAEVVFHLLGNFLYLFLLSTVLGVATGLISALVIKKIYFGRHSTDREVALMMLMAYLSYMLAELFALSGILTVFFGCIVMSHYTWHNVTESSRITTKHAFATLSFLAETFIFLYVGMDALDIEKWRSVSDTPGKSIAISSILMGLVMLGRAAFVFPLSFLSNLAKKNEHEKISWKQQVVIWWSGLMRGAVSMALAYNKFTRAGHTEVRGNEIMITSTITVVLFSTVVFGLLTKPLIRLLMPHRHLTMLSDDSTPKSLHSPLLTSQLGSSIEEPTQIPRPTNIRGEFTTMTRTVHRYWRKFDDKFMRPMFGGRGFVPFVPGSPTERNPHDLSKP

SEQ ID NO: 11563 - protein, 692 aa, Arabidopsis thaliana
MAPRLDFSDWWAKDTRKGTPVVVKMENPNYSVVEIDGPDSAFRPVEKSRGKNAKQVTWVLLLKAHRAVGCLTWLATVFWSLLGAIKKRLSFTHPLGSEKLGRDRWLFTAIKLFLAVSLVILGFEIVAYFRGWHYFQSPSLHIPTSTLEIQSLFHLVYVGWLTLRADYIAPPIKALSKFCIVLFLIQSVDRLVLCLGCFWIKYKKIKPRFDEEPFRNDDAEGSGSEYPMVLVQIPMCNEREVYEQSISAVCQLDWPKDRILVQVLDDSNDESIQQLIKAEVAKWSQKGVNIIYRHRLVRTGYKAGNLKSAMSCDYVEAYEYVAIFDADFQPTPDFLKLTVPHFKDNPELGLVQARWTFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLGSILTSKIAIWKKANLILLFFLLRKLILPFYSFTLFCIILPLTMFVPEAELPVWVICYIPVFMSFLNLLPSPKSFPFIVPYLLFENTMSVTKFNAMVSGLFQLGSSYEWIVTKKAGRSSESDLLSITEKETPTKKSQLLRGVSDSELLELSQLEEQKQAVSKKPVKKTNKIYHKELALAFLLLTAALRSLLAAQGVHFYFLLFQGVTFLLVGLDLIGEQMS

SEQ ID NO: 11564 - protein, 410 aa, Glycine max
VLADLIVTQLFYDTDIFLKFVNDCRQIGITCPIVPGIMPINNYKGFIRMTGFCKTKIPADIMAALEPIKDNEEAVKAYGIHLGTEMCKKILAHGINTLHLYTLNMEKSALAILMNLGLIEETKVSRSLPWRRPANVFRVKEDVRPIFWANRPKSYISRTIGWDQYPHGRWGDSCNPSYGALSDYQFMRPRARDKKLVEEWAVPLKSIEDIYERFRLYCLGKLRSNPWSELDGLQPETKIINELLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEGDASRKLVEEVGGSYFLVSLVDNDYINGDLFTVFADF

SEQ ID NO: 11565 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGXXXXXRQAIEYAIANDRDSVTLVHKGNIMKFTEGAFKDWGYELARKEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 11566 - protein, 173 aa, Zea mays
PNVDPELALALRLSMEEERARQEAIAKKAAEDTSNTENINASSSNSDSVMAEAELASNAAAGDKQEQPKDDDDLLQQALAMSMEGGASGSAAVTDSAMAEAALQMSVQDANMSSDTDMSKVFEDRTFVSSILNSLPGVDPNDPSVKDLLASLHSQGEQEKKEDKSDKTEDEKN

SEQ ID NO: 11567 - protein, 458 aa, Staphylococcus epidermidis ATCC 12228
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 11568 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 11569 - protein, 310 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVIYPAPILVEKETEEKKTAYPKFVFEDYMKLYAGLKFQAKEPRFDAMKAAAKA

SEQ ID NO: 11570 - protein, 476 aa, Glycine max
MKKENSVMLKAGELPGRLTRARAAAALRAYGQLPPLKERAQQNQNQLSRVNSKRAVSDNTCVQRKRKAVLQEVTNVCCENAYKACLNSTNIQARKSKLAKAGQINVSKVAPSVTVEPRQFQVDSKAKETALQSEDTMCSINLENNELLQLNANDCSKDFRLPESQMSGISAHPLISQKKDTKDNLPKLLTALKDSDITNIDDDDLEDPQSCSLYAADIYDTIRVAELARRPYPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLNFLPSIIAASAVFLARWTLDQSNHPWNPTLQHYACYKASDLKTTVLALQDLQLNTDGCSLTAVRTKYRQDNFKCVAALSSPKLLETLF

SEQ ID NO: 11571 - protein, 321 aa, Oryza sativa (japonica cultivar-group); identical to SEQ ID NO: 2767

SEQ ID NO: 11572 - protein, 362 aa, Zygosaccharomyces rouxii
MSKNIVVLPGDHAGQEIAQEAIKVLEAISEVSPEAKFNFQHHLIGGAAIDATGSPLPDDALAAAKKADAVLLGAVGGPKWGTGSVRPEQGLLKIRKELQLYANLRPCNFASESLLDLSPLKPQHAKGTDFVVVRELVGGIYFGERKEDEGDGVAWDSEKYTKPEVQRLTRMAAFLALQHNPPLPIWSLDKANVLASSRLWRKTVEETIKNEFPQLKLNHQLIDSAAMILVKSPTQLNGIVLTSNLFGDIISDEASVIPGSLGLLPSASLASLPDTNEAFGLYEPCHGSAPDLPKGKVNPIAMILSAAMMLKLSLNLSKEGEAVEKAVKQVLDSGVRTGDLGGSNSTSEVGDAIAKAVKEILA

SEQ ID NO: 11573 - protein, 427 aa, Caloglossa leprieurii
AGESSTATWTVVWTDLLTACDLYRAKAYKVDAVPNTSDQFSAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTIIIMIDLVIGYTAIQTMAIWARKNDMILHLHRAGNSTYSRQKIHGMNFRVICKWMRMSGVDHIHAGTVVGKLEGDPLMIRGFYNTLLLPYLDINLPQGIFFQQDWASLRKVTPVASGGIHCGQMHQLLDYLGNDVVLQFGGGTIGHPDGIQAGATANRVALESMVIARNEGRDYVAEGPQIVRDAAKTCGPLQTALDLWKDSTFNYTSTDTADFVETPTANV

SEQ ID NO: 11574 - protein, 471 aa, Arabidopsis thaliana
MCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRDYAYPRPVAIAVAQLVMSVGHIFFAYGWPGAMHIGTLLIGLGYGAHWAIVPATASELFGLKKFGALYNFLTLANPAGSLVFSGLIASSIYDREAERQAQGSLFNPDDVLRCRGSICYFLTSLIMSGFCLIAAALSMILVQRTKPVYTNLYGKTRN

SEQ ID NO: 11575 - protein, 340 aa, Rhodobacter sphaeroides
MATRKSPEQSNASKEELVRYYREMLLIRRFEEKAGQLYGMGLIGGFCHLYIGQEAVVVGLEAAAKEGDKRITSYRDHGHMLACGMDAKGVMAELTGREGGYSKGKGGSMHMFSKEKHFYGGHGIVGAQVPLGAGLAFADRYLGNDNVTFTYFGDGAANQGQVYEAYNMARLWSLPVIFVIENNQYAMGTSVKRSTKSPSLWERGAAYGIKGESVDGMDVLAVKAAGEKAVAACRAGQGPYILEMMTYRYRGHSMSDPAKYRTREEVQRMRDEKDAIEHVRDLADPGQSRDRRRPQGDRQGDQGRGERGRRLRQGEPRARARGTLDRHLRLRSKDAWQPRF

SEQ ID NO: 11576 - protein, 461 aa, Glycine max
MSMSLSLLRIFSSPHLSTSLFFPTPTLSSLCPSFLSKLPNAPSPLIVLCHRDASASKQGHLGVPESAERDSGSEEDDDAVEQPMRASYDDDEDEEEGALSSLVFPERWDVLGLGQAMVDFSGMVDDNFLKNLGLEKGTRKVVNHEERGRVLQAMDGCSYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 11577 - protein, 209 aa, Dechloromonas sp. RCB
MKLTSGSFADGQTIPGDYSFCIPDPAHHVCLGSNKNPQLSWSDVPAGTKSFAVICHDPDVPSQGDDVNQEGRSVPASLPRVDFFHWVLIDLPASITSLKEGEFSGEVTPRGKPGPQAAYGARQGINNYTDWFAGDNDMRGDYYGYDGPCPPWNDEIIHRYVFTVYALDIEQLPLAGKFGGPEARAAIQGHILAEACLIGTYTLNRKLLG

SEQ ID NO: 11578 - protein, 366 aa, Pseudomonas stutzeri
MSADFLALAVPGVQKLSPYVTGKPIDELARELGIEPARIVKLASNENPLGPNPRVLEAVRGELSELTRYPDGSGFRLKAKLAERFGLKSEQITLGNGSNDIIDLVARCCGAGPNAVFSAHAFAAYPLCTQAAGAESRVVPAVDYGHDLDGMLKAIDEQTAVIFIANPNNPTGNLVRAQALESFLDRVPERVLVVLDEAYIEFYRGTNCQRLNYLVRYPNLLVSRTLSKVYGLAGLRVGYSASSPQIADVLNRVRQPFNVNSLALVAACAGWMTSSIWLKGGGWIAPVWELEQGLAELRLKWIPSRGNFLAVDLGRDAAPINAGLLRDGVIVRPIAGYDCPTFLRVSIGTEQENARFLEALRVVLDQ

SEQ ID NO: 11579 - protein, 309 aa, Schizosaccharomyces pombe
MEACRVRPELSKTVEQIDKSLWRLNIDSAGGETWEYVTKEEAEKRPLTIAEKYFLGFDLDLPKRPPAKTPLESAEYGYEFFRRLQLPDGHWASPYEGPMFLICGAVFAFYISQTPFPKGWAPEIIQYLINHTNDDGGWGIHTEGVSTVFGTSMNYVVLRILGMDAGHPVATRARNRLHELGGAIGCPHWGKFWLATLNCYDWDGVNPIPPELWLLPDWIPFHPGKWWCHVRLVYLPMGYMYGERLKCPKDSLIMQLRKELYVENYDSINFADHRNTISDVDLYFPHTQILDRLNWILEKYFTYLRPSWL

SEQ ID NO: 11580 - protein, 171 aa, Vibrio cholerae
ICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 11581 - protein, 165 aa, Zea mays
MDGRMFGLETPLMVALQHLLDVPDGDAGAGGDKASGAAAGGGPTRTYVRDARAMAATPADVKELPGAYAFVVDMPGLGTGDIRVQVEDERVLVISGERRREEREDAKYLRMERRMGKFMRKFVLPDNADMDKISAVCRDGVLTVTVEKLPPPEPKKPKTIEVKVA

SEQ ID NO: 11582 - protein, 570 aa, Saccharomyces pastorianus
MSHVNASYAHSQGSSTSVSRVEMEKPATKEVFEDPTPKKFELDDDEAGKTSSVFNPDLNLEEEVRALDELGDSFKRDRSFWGKMKALEFEVEFENKKNMVLMLGTFAAFAGILSGIDQSIISGASIGMNKMLHLSTHEASLVSSLMPLGAVAGSILLTPFSEYFGRKKSLAISCVFYTIGAIVCAAASNHHEMYAGRFLIGVGVGLEGGGIGVYIAESVPSSVRGSLVSLYQFNIALGELFGYIVGVIFFDVKGGWRYMVGSSLVFSTTLFIGLLFLPESPRWLMHKGRVGESWNVWKRLRDVKEEGNKIEFLELRDVASHDRELHANESRFQSLFDLVRVPRNRRALVYSCMMIGLGQLTGINAIMYYMSTLMKNIGFDDKQSVAMSMVGGAALLIGTVPAILWMDRFGRRTWAMTIIIFIVGLVLVGVGYQINLKTHMAAAEGVYLTGQIIYNMAFGSYAALTWVLPSESFSLGTRSAGMTVSSALLYLFAFTVTYNFEKMKEAMTYTGLTLGFYGGIALAIGIPYQLLCMPETKNRTLEEIDDIFEKPTSQIIKENIAYLKKGQLSY

SEQ ID NO: 11583 - protein, 265 aa, Thermosynechococcus elongatus BP-1
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 11584 - protein, 863 aa, Bacteroides thetaiotaomicron VPI-5482
MKKVLLTLSLSIVASMGSFAQNEPYKNPKLTPEERAEDLLGRLTLKEKIGLMKNSSFAVERLGVAPYNWWSEALHGVARNGLATVFPITMGMASTFDDEAIERVYVAVSDEGRAKFHDAHRSNRYGYGNEGLTFWNPNVNIFRDPRWGRGQETFGEDPYLTTRMGVAVVKGMQGPADAEYDKAHACVKHYAVHSGPEAKRHSFDVEDLSPRDLWETYLPAFKALVQEADVKEVMCAYQRLEGEPCCDSNRLLTQILRDEWGYKHLVVSDCGAIDDFFVKGRHETHKDAADASASAVINGTDLECGSIYSHLEEAVKQGLITEERIDTSLRRLLKARFALGEMDPDSIVPWSRISIDTVDCDLHKQMALDLARKSMVLLCNNGVLPLAKTGARIAVMGPNAVDSVMQWGNYEGVPSHTYTILEGIRCKIGDVPFEKGCELLDNRIFESYFNEISNNGRPGLTATYWNNMNLSGDVAATSQITSPINLSNGGNTVFATGVGLYNFTAVYEGTFRPKESGAYELLIEGDDGYRVYVNGEKVIDYWGEHASAKREYTLKAIAGTDYKIRIEYMQAGAEALLRFDLGIYRHISPEMVVDRVKEADIVIFAGGISPSLEGEEMYSVNSPGFAGGDRTSIELPQVQRDILKALKKAGKKVVFVNCSGSAVALVPEMESCDAILQAWYPGQSGGLAVADVLFGDFNPSGKLPVTFYRSTDQLPDFEDYSMKNRTYRYMTEVPLFPFGYGLSYTTFDISKGRLNKKIISAGQDLNFKVNVKNTGKYDGAEVIQVYVRKVDDAEGPIKSLRAFRRVPLKAGETCVVSIDLLPTTFEFFDPTTNTMRIMPGKYEIMYGNSSDIPSGNKLSVTLR

SEQ ID NO: 11585 - protein, 423 aa, Corynebacterium efficiens YS-314
MTTHPLTMPIPEYFEEILESVRSDVSGEVAQYIPQLKDADPNPLALAMCTVDGHIYGAGDDEHEFTMQSVSKPFAYALALQEQGPEKVFATVGLEPSGEAFNELSLDGSTNRPMNPMINAGAIAVNQLINGSESSVEDRVEKIRSYFSALAGRELNIDRQLSETEIEGADRNLSIAHMLRNYGIIEDDAHDAVLSYTLQCSVKVTARDLAVMTATLAAGGTQPLTGEKLVDARVARLVLSTMASAGMYDEAGQWLATVGIPAKSGVSGGLVGVLPGQLGLATFSPRLNSQGNPVRGVEIFKALSEDMGLHLMSAELLTQHAVRAIEERGDTTVIQLQGAMNFSAAENFLFTVTDHDFTGEKVVLDISRVPMFRPMGRRLVKEGLRRIRDNGFKVAIYDPEDILPDFDFSDGTKSPQVDDPEEL

SEQ ID NO: 11586 - protein, 500 aa, Neisseria gonorrhoeae
MTTSKCPVTHLTMNNGAPVADNQNSLTAGTRGPLLTQDLWLNEKLADFVREVIPERRMHAKGSGAFGTFTVTRDITKYTRAKIFSEVGKKTEMFGRLATVAGERGADAYTRVRGFALKFYTEEGNWDVVGNNTPVFYPDLRKFPDLNKAVKRSAHQYSSATNNWDFWALLPEALHQVTIVMSDRGIPASYRHMHGFGSHTYSLWNEAGERFWVKFHFRSQQGIKNLTNEEAAKIIADDRESHQRDLYEAIERGEFPKWTMYIQVMPEADAAKVPYHPFDLTKVWPKKDYPLIEVAEFELNRNPENFFADVEQSAFAPSNLVPGIGASPDKMLQARLFNYADAQRYRLGVNFRQIPVNRPRCPVHSNQRDGQGRATELRQPAHYEPNSFGQWSQQPDFAEPPLKINGDAAHWDYRQDDDDYFSQPRALFNLMNDAQKQALFDNTAAAMGDAPDFIKYRHIRNCYRCDPAYGEGGSKALGLTVEEPQAARATDPALGQGGLL

SEQ ID NO: 11587 - protein, 271 aa, Ralstonia metallidurans
MEHEYLRHARHDESHAHRDGVNPVPLNRPKSPPMDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELVG

SEQ ID NO: 11588 - protein, 116 aa, Oryza sativa (japonica cultivar-group)
MRSATLAKAGGREAAAEEEVVLWREDARRFETPDGEAYLQYRLLAAAQPRSSSSGDGGGGGGATTPAAVMEMAHTYVPGSKRGRGLAARLCDAAFAHARERGMRVLPTCSYISVRL

SEQ ID NO: 11589 - protein, 80 aa, Glycine max
  unsure (1)..(80): unsure at all Xaa locations
SQTDTTVNRTDAGAIAXLTGLKSMAGLRTRXTNTDITFIASNCGRTQCMQVXSPIGXKKSETSFYLPDLDDAQLAKEVEY

SEQ ID NO: 11590 - protein, 503 aa, Micrococcus luteus
  unsure (1)..(503): unsure at all Xaa locations
MEHQKTTPHATGSTRQNGAPAVSDRQSLTVGSEGPIVLHDTHLLETHQHFNRXNIPERRPHAKGSGAFGEFEVTEDVSKYTKALVFQPGTKTETLLRFSTVAGELGSPDTWRDVRGFALRFYTEEGNYDLVGNNTPIFFLRDPXKFTHFIRSQKRLPDSGLRDATXQWDFWTNNPESAHQVTYLXGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQXWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 11591 - protein, 461 aa, Escherichia coli
  unsure (1)..(461): unsure at all Xaa locations
MADNKPELQRGLEARHIELIALGGTIGVGLFMGAASTLKWAGPSVLLAYIIAGLFVFFIMRSMGEMLFLEPVTVAFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGXFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 11592 - protein, 246 aa, Azotobacter vinelandii
MRGKLVIGNWKMNGSLDANRRLLQELLPPLAAVKGLEVAVCPPFPYLAQVGALLEGSSVALGAQNLHSAGQGAFTGEVGAGMLEELGCRYVLVGHSERRSLFGESDETVAEKFEAALRAGLVPVLCVGETLAQRRDGSTEAVIAGQVRAVLQRVGGAGIAAGVIAYEPVWAIGTGETASPEQAQAVHRHIRALLGEATATPILYGGSVKPDNAAALFAQPDIDGGLIGGASLEAASFLAICRAAQS

SEQ ID NO: 11593 - protein, 540 aa, Zea mays
MGLGVDAETVRLGVLSSTSDHASVVSNNFFVALLCACIVLGHLLEENRMVNESITALLVGLGTGTVILMISRGVSIHVLVFSEDLFFIYLLPPIIFNAGFQVKKKQFFRNFITIILFGAIGTLISFVIISLGAMGVFKKLDVGPLELGDYLAIGAIFSATDSVCTLQVLNQDETPLLYSLVFGEGVVNDATSIVVFNALQNFDITHINAEVVFHLLGNFLYLFLLSTVLGVATGLISALVIKKIYFGRHSTDREVALMMLMAYLSYMLAELFALSGILTVFFGCIVMSHYTWHNVTESSRITTKHAFATLSFLAETFIFLYVGMDALDIEKWRSVSDTPGKSIAISSILMGLVMLGRAAFVFPLSFLSNLAKKNEHEKISWKQQVVIWWSGLMRGAVSMALAYNKFTRAGHTEVRGNEIMITSTITVVLFSTVVFGLLTKPLIRLLMPHRHLTMLSDDSTPKSLHSPLLTSQLGSSIEEPTQIPRPTNIRGEFTTMTRTVHRYWRKFDDKFMRPMFGGRGFVPFVPGSPTERNPHDLSKP

SEQ ID NO: 11594 - protein, 80 aa, Oryza sativa
VNMEVQAEFMEGAMAGSTSLSTPETEVNSLMQQVADDYGLEVSVGLPQAAAHAIPAAKEKEKAVDEDDLSRRLAELKARG

SEQ ID NO: 11595 - protein, 227 aa, Triticum aestivum
  unsure (1)..(227): unsure at all Xaa locations
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLXHQPESLHTFFFLXXDDVRXSPPNYRPHWTGFGGQQPTTFVFPCPAKFPLT

SEQ ID NO: 11596 - protein, 361 aa, Triticum aestivum
SCIQEGRASCLMCSYNQVNGVPACAHKDLLQKIRDEWGFKGYIVSDCDAVAIIHENQTYTSSDEDSVAIVLKAGMDVNCGSFLIRHTKSAIEKGKIQEEDINHALYNLFSVQLRLGLFEKTSENQWFTRLGPSNVCTKEHRELAAEAVRHGTVLLKNDNSFLPLKRSEVSHIAIIGAAANDAYIMGGDYTGVPCDPITFLKGMQAFVPQTTVAGGCKNVSCDSTDGFGEAIEVAKRADIVVVNAGLNLTQETEDLDRVTLLLPGKQQDLVHIIAGVTKKPIVLVITGGGPVDVSFAKQDPRIASVLWIGYPGEVGGQVLPEILFGEYNPGGKLTMTWYPESFTAVPMTDMNMRADPSRGYP

SEQ ID NO: 11597 - protein, 477 aa, Ceramium affine
KNERYESGVIPYAKMGYWDPEYAVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLESYLKVDLPKGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 11598 - protein, 361 aa, Saccharomyces cerevisiae
MKGLILVGGYGTRLRPLTLTVPKPLVEFGNRPMILHQIEALANAGVTDIVLAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 11599 - protein, 462 aa, Botrydiopsis alpina
KSDRYESGVIPYAKMGYWDADYNVKHTDILALFRITPQPGVDPVEAAAAVAGESSTATWTVVWTDLLTACDIYRAKAYRVDPVPGTTDQFFAYIAYECELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCIEGVNRAAASTGEVKGSYLNCTAGTMEEMYERAEYAKKTGTIIVMIDLVIGYTAIQSMAIWARKNDMILHLHRAGNSTYARQKNHGINFRVICKWMRMAGVDHIHAGTVVGKLEGDPLMVKGFYNTLLETKLDINLSQGMFFEMDWAALRKVVPVASGGIHCGQMHQLLYYLGDDVVLQFGGGTIGHPDGIQAGATANRVALEAMVLARNEGRDYLNEGPQILRDAAKMCGPLKTALDLWKDITFDTL

SEQ ID NO: 11600 - protein, 645 aa, Glycine max
  unsure (1)..(645): unsure at all Xaa locations
TRLKQYCSXDMDGTKNMGVLIQGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKKLLESGELTQEEIDRIHKKVTSILNEEFLASKEYIPKRRDWLSAYWLGFKSPEQLSRIRNTGVKPEILKNVGKAITTIPENFTPHRAVKRIYEQRAQMIETGEDIDWGFAEALAYATLLIEGNHVRLSGQDVERGTFSHRHAVVHDQTTGEKYCPLDNVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHREFRKPLIVMSPKNLLRSKACRSNLSEFDDVQGHPGFDKQGTRFKRLIKDQNDHKDVEEGIRRLVLCSGKVYYELDEHRTKVDAKDVAICRVEQLCPFPYDLVQRELKRYPNAEVVWCQEEPMNMGGYTYILPRLISSMKAVNRGGYDDVKYVGRAPSAATATGFLKVHQKEQTEIAEKALQQEPIDFPF

SEQ ID NO: 11601 - protein, 149 aa, Thermosynechococcus elongatus BP-1
MSWLEHTVQIEVAAAVDRVWALWSDLEKMPLWMKWIESVVITPEDPTLSRWTLATGNWHFSWRSRICRQVKHQIIQWESVDGLPNRGAIRFYDRQGSTIVKLSVAYAIPGVLGQIMDRLFLGRVVESTLQADLERFREYAQRMQPTQVS

SEQ ID NO: 11602 - protein, 528 aa, Triticum aestivum
MAHVHVDEMLHEAAAAAPRSLLIATAVLFSLVVLPLLLRIIAKQGAASDAKLLSLLPSPPTRLPIIGHLHLMGDLPYVSLAGLAAKYGPELMLVHLGAVPTAVVSSPRTAEAVLRTHDHIFASRPRSMVFDIIMYGQTDSCFSPYGEHFRKARKLVTVHMLNARKIRSQRPAREEEVRQVIGKIAKAAAAREAVDMSELLHSYVNDLVCRAVSGKFSQEEGRNKLFRELTDINAALLGGFNILDYFPSLGRFELVCKVACAKARRVRKRWDLLLDKLIDDHAARMVSREGEAQPEQEEDKDFIDVSLSLQQEYGLTRDHIKAILIDMFEAGTDTSYMTLEFAMAELIRKPHLMKKLQEEVRRNVPNGQEMAAEDDLPNMTYLKAVIKETLRLHPPVPLMIPHFSLDACTVDGYTIPANTRVVINAWALGRHSGYWENENEFQPERFMNGAGVDLKPNEFHYLPFGFGRRMCPGVHSASATVETMLANLMYRFDWKLPPGLKEENIDMTEVFGITVSRKEKLILVPVTA

SEQ ID NO: 11603 - protein, 451 aa, Neisseria gonorrhoeae
RFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 11604 - protein, 860 aa, Oryza sativa; identical to SEQ ID NO: 3098

SEQ ID NO: 11605 - protein, 377 aa, Zea mays
MALSKEQKLTIPDQQHTTSSEQQVALDAELQLWNHTFGYVKSMALKAALDLGIPDAIHQHGGSATIPQIVTRITLHPSKTPCLRRLMRVLTLTGVFGTQEPHDDGGGCDDELVYTLTPASRLLVGPSGQNVSPLLNVMLCPILVSSFLDLRGWFQHEMPDPSPFKVTHGRDIWELAAHDAGFRRLVESPGLQADSGFIMNVVVRECGSGTVFQGISSLVDVGGGFGGATQAIAKAFPHLECSVLDLPNVVAGAPADTAVKYVAGDMFESVSSADAVFLKSIIHDWGDADCVKILKNCKKAIPAQGGKVIILDIVVGAGSSCDRKNVETQCLFDLYIMTINGVERDEREWKKIIFEAGFTSYKIIPVLGTRSIIEVCP

SEQ ID NO: 11606 - protein, 343 aa, Oryza sativa
  unsure (1)..(343): unsure at all Xaa locations
MANLGGGAMPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSXCGQAAPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 11607 - protein, 480 aa, Phycodrys quercifolia
GKVKNDRYESGVIPYAKMGYWDPEYVIKETDILALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMEEMYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPQLEVNLPLGIFFKQDWASLRKVTPVASGGIHCGQMHQLLDYLGNDVVLQFGGGTIGHPDGIQAGATANRVALESMVIARNEGRPYVEEGPQILRDAAKTCGPLQTALDLWKDITFNYTSTDTADFVETPTANV

SEQ ID NO: 11608 - protein, 341 aa, Streptococcus pyogenes MGAS315
MMTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEVGACGTAAVISPIGGIQYKDNLHVFYSETEVGPVTRRLYDELVGIQFGDIEAPEGWIVKVD

SEQ ID NO: 11609 - protein, 574 aa, Schizosaccharomyces pombe
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 11610 - protein, 509 aa, Streptomyces avermitilis MA-4680
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 11611 - protein, 348 aa, Actinosynnema pretiosum subsp. auranticum
MTLTDDEHTAHRHDEGAAAFQALATAAAGWGALRAAVELRLPDLLPDAPTAVPDLAALAGVAPTRLAQLVAVLADVGVLALDERAHVRHTPLSRALRSTDGLALTRLLTAGWADEAWRGLAEGVRTDTSPLELVHGRPLFDLLAADPAAAAVFHDAVATGPGDPFDEAIRSALDLTGAARVVDVGGGRGRLLAALLREHPVLSGVLFDLPEAVRDAVPELRGDDRVQIRAGDLFADRVGAADVYVLRTVLHVLDDAQAVRALANVRADAPAHARVVVVEALSDDEANRTYAAHSSLRLFVLCGGRERSTAEFAELFDRAGLELRSVTPTGTPYHLLEGAPRLSPRTDG

SEQ ID NO: 11612 - protein, 334 aa, Yersinia pestis CO92
MEYMTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 11613 - protein, 107 aa, Hordeum vulgare subsp. vulgare
MAEAAHGGGLRGRGVLLGGVQDAPAGRENDLETIELARFAVAEHNAKANALLEFEKLVKVRQQVVAGCMHYFTIEVKEGGAKKLYEAKVWEKAWENFKQLQEFKPAA

SEQ ID NO: 11614 - protein, 291 aa, Oenococcus oeni MCW
MVQKVKKAVIPAAGLGTRFLPATKALAKEMLPIVDTPTIQFIVEEAIQSGIEDIVIVDGKSKRSIEDHFDSNTELEDNLSAKGKDKLLKLVQDTTDLNIYFIRQSHPHGLGDAVLKAKSFISNEPFVVMLGDDLMTDRVPLTKQLVDRYNETEQSTLAVMPVPHEETSKYGVIDPSKEVKPGLFEVKNFVEKPRPQDAPSDLAIIGRYLFTPTIFSELENTMPGKGNEIQLTDAIESLNHKEHVYAHQFDGKRYDIGSKIGFLETNIEFGLKHPDTGDELRKYIKELAKTL

SEQ ID NO: 11615 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVBHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 11616 - protein, 111 aa, Ipomoea batatas
YFLYQILRGLKYIHSANVIHRDLKPSNLLLNANCDLKICDFGLARPNIENEFMTEYVVTRWYRAPELLLNSSDYTGAIDVWSVGCIYMELMNRKPLFPGKDHVHQMRLLTE

SEQ ID NO: 11617 - protein, 346 aa, Brucella suis 1330
MAPRAKKAPAGKTQASSVNAPKAPSPANFDKKQELEAYREMLLIRRFEEKAGQLYGMSFIGGFCHLYIGQEAVVVGMQMALQEGDQVITGYRDHGHMLAVGMSARGVMAELTGRRGGLSKGKGGSMHMFSKEKNFYGGHGIVGAQVSLGTGLAFANHYRENKSVSLTYFGDGAANQGQVYESFNMASLWKLPVIYVIENNRYAMGTAVSRSSAETDFSKRGLSFNIPGIQVDGMDVRAVKAAADLATEWARSGKGPIILEMLTYRYRGHSMSDPAKYRSKEEVQKMRSEHDPIEQVKNRLIEKGWATEEELKEIDREVRDIVADAADFAEHDPEPDASELYTDILL

SEQ ID NO: 11618 - protein, 313 aa, Ceratopteris richardii
MAMPCSDIDLLDSDNDNVDDQHISLELRQVHEDTDDGSHDEPRELSLLNHESNLCKIVNSKGKGAEAGNSLLPSTGTSRGKIQIRRIENTTSRQVTFSKRRNGLLKKAHELSVLCDAEIALIIFSSTGKLFEYSSSRGIKKILERYKRCSGILQDVGGTVIRDVEYWKQEAERLKERLTYMEEIQRNMLGESLGSLQIKDLQNLEAKLDSGLYKIRGAKTQLMARQVQELQKKEQILLQQNEALRAKLAELSCLQAPVSGLTTATTSQDVQESSSGRGSRQRETSLSAAETTLQLASHNEQTFLLRAVPHMRL

SEQ ID NO: 11619 - protein, 505 aa, Helicobacter pylori J99
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGEKGSADAVRDPRGFAMKYYTEEGNWDLVGNNTPVFFIRDAIKFPDFIHTQKRDPQTNLPNPDMVWDFWSNVPESLYQVTWVMSDRGIPKSFRHMDGFGSHTFSLINAKGERFWVKFHFETMQGVKHLTNEEAAEVRKYDPDSNQRDLFDAIAGGDFPKWKMSIQVMPEEDAKKYRFHPFDVTKIWYLQDYPLMEVGIVELNKNPENYFAEVEQAAFTPANVVPGIGYSPDRMLQGRLFSYGDTHRYRLGVNYPQIPVNRPRCPFHSSSRDGYMQNGYYGSLQNYTPSSLPGYKEDKSARDPKFNLAHIEKEFEVWNWDYRAEDSDYYTQPGDYYRSLPADEKERLYDTIGGSLAHVTHKEIVDKQLEHFKKADPKYAEGVKKALEKHQKMMKDMHAKDMHHMKKKK

SEQ ID NO: 11620 - protein, 494 aa, Bacillus anthracis str. A2012
  unsure (1)..(494): unsure at all Xaa locations
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVXVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 11621 - protein, 168 aa, Triticum aestivum
  unsure (1)..(168): unsure at all Xaa locations
MAQESLRLVCPPVSAHEGRLPRQYTLEGQGAKKDISPPLEWYGVPDGTRSLXAVVVQDVDADERVXPWTHWVVVNISPEEKGLPEGFSGAXGGNANAGGGDGGVQEGVNDWKQPGWRGPVPDSHGHRIQFRLYALDDVLSLGNKVTVDKVMEAIEGHVLGEAEITAVF

SEQ ID NO: 11622 - protein, 709 aa, Lactobacillus plantarum WCFS1
MPIIELVILLACLVLLSNVLSHYLVAIPVSLIQVGLGLGVALLLNVQVKLQTDWFMLVFIAPMLYNDGREFPKQELWELRGAIFANAIVLVFITTILGGFLIHVLIPTIPLAVGIALAAILSPTDPIAVQSISEGVKLPKEILHLVSGESLINDASGLIGFKYALAAAVTGTFVLGEAVGDFFYISLVGLAVGLALITIIQLIRDVLRREGINDIVFNVVLQILTPFAIYFIAEEWFHASGVVAVVAAGVLSHLQNSHESEDAPELRLVTERVWNVVVYLLNGIVFLILGIELPAATQATIKGAHTNTFHAVFDVLIVWGILLLIRVAWTYAYMLFNWLRHHKKAKPSLRIAALSGLSGVRGAITMAGVFTIPTVVASGKAFPERALVLFIAAGVIIVSLVAAAAILPLMAAKSLPFVTRGSSPDEDDAVLAEGTDDGDDSSGQLPQLTYKQARIYILQLAIQNIEEHRRPANQRAAYDLILDQQFQIRRLEVASQTADELAPMLTDELELRLVALNGERAAVREMIANKQTSKLAGQVYLRRVDRREQRFLQATHRQGLPTLRSLRLLLTRAMQGIRLWLAPGDSEELRVALLDIQREASKAAIKALSQYLKQANVDEQQFDRQALYHLIVHYRNRIENAKNDHTLSRDDYEQQLHGLRIKSLGAERAGVQHLLESGQISLRTAAKLRQFINYSENLLMLNDIEADED

SEQ ID NO: 11623 - protein, 389 aa, Clostridium tetani E88
MDVKEMALKLHSEKKGKLEVVGKISVKNREDLALAYTPGVAEPCVHISKDKNKVYEYTTKGNMVAVVTNGTAVLGLGNIGPEAALPVMEGKALLFKEFANVDAFPICLDTEDPEEIIRTVKLMAPGFGGINLEDIKAPECFYIEERLKKELDIPVFHDDQHGTAIVVLAGIYNALKIVDKKLEEAKILINGAGSAGIAICKLLLNAGACNIVMCDINGSLVEGDENLNPAQKEIAKVTNKEKEKGKLVDVIKDKDIFIGVSGPKILTKEMVSTMAKDSIVFAMANPEPEILPDEAKAGGARVVATGRSDFPNQINNVLVFPGIFRGALDVKAREINEEMKIAAARGVANLIKEEDLNEEYIIPDPFNKEVAESVSKEVRRIAKEMNICK

SEQ ID NO: 11624 - protein, 472 aa, Rhodogorgon carriebowensis
  unsure (1)..(472): unsure at all Xaa locations
ESGVIPYAKMGYWDPEYIVKETDVLALFRVTPQPGVDPIEASAAVAGESSTATWTVVWTDLLTACDLYRAKAYKVDPVPNSAEQYFAYVSYDIDLFEEGSIANLTASIIGNVFGFKAVKALRLEDMRITLSYLKTFQGPATGTIVEREPMDKFGRPFLGATVKPKLGLSGKNYGRVVYEGLKGGLDFLKDDENINSQPFMRWKERYLYAMEGVNRSIAASGEVKGHYLNVTAATTEIMYERAEFAKALGSIIIMVDLVIGYTAIQTMAIWARRNDMILHLHRAGNSTYSRQKSHGMNFRVICKWMRMAGVDHIHAGTVLGKLEGDPLMIRGFYNTLLFTHLDVNLPQGLFFEQEWASLRKVTPVASGGIHCGQMHQLLDYLGVDVVLQFGGGTIGHPDGIQAGATANRVALESXXXARNEGRDYVAEGPQILREAAKTCGPLQTALDLWKNITFNYTSTDTADFVETPTANV

SEQ ID NO: 11625 - protein, 190 aa, Triticum aestivum
  unsure (1)..(190): unsure at all Xaa locations
SYDFKTHKSISCARKVNPSDVIILEGILLFHDSRVRDLMNMKIFVDTDADVRLTRRIRRDTIEKGRDIIAVLDQYSKFVKTAFEDFILPTKKYADIIIPRGADNSVAIDLIVQHIRTKLGQNDLCKIHPNLYVIQTTYQIRGMHTIIRDAATTTHEFIFXPDRLXXXGCXAWALGHLPSREKASQLLQLG

SEQ ID NO: 11626 - protein, 188 aa, Yersinia bercovieri
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYK

SEQ ID NO: 11627 - protein, 192 aa, Schizophyllum commune
EFPYLITPLDAITARAQEDGTTVTSSLSDSDTARAAQIAAAADVAIVFISSDSGEGYLTVEGNAGDRNDLLAWHDGDALVQAVADANENTIVAVNTVGAIITEAWIEHPNVKAVVWSGLPGQEAGNSVADILYGAYNPSGRLPYTIAKSADDYPAQVLYESSAQVPDIDYSEGLLVDYRHFDANGIEPRFEF

SEQ ID NO: 11628 - protein, 276 aa, GIBBERELLA ZEAE PH-1
MASKTKYQTAPQSDPDDDYTHAPPAYAEGSAARDETQGLFGAPRDSEDNLPDDFKFGGSVAEATVDIRNQFVRKVYTILTVQLLATAGVSSLTFFSTGYKDWIQSHPGVVWASLFGSMIFMGLTYWKRKSYPTNLLFLSLFTLAEAYTISVIVSFYKTSIVLNAVVLTAGIFVFLTLFACQTKYDFTSWMPYLFGALWGLVIFGFMAMFFPYSSTGELIYGGLAALIFSGYILVDTQLVLRHHHVEEEIAAAISLYLDIINLFLAILRILNSQSNN

SEQ ID NO: 11629 - protein, 340 aa, Nicotiana tabacum
GIPLLASPNSSIYGRSSGGGGDCYDQSQAVVHPIVKTEGGSTSHHHTFQYPSIIRSGYHHLTVQNHHESESSGSEVDALKAKIIAHPQCSNLLDAYMDCQKVGAPPEVVARLSAVRQEFEVRQRDSSTDRNIAKDPELDQFMEAYYDMLVKYREELTRPLHEAMDFMRKIETQLNMLGNGPVRIFNSEDNCEGVGSSEEEQDNSGGETEIPQIDPRAEDRELKNHLLRKYSGYLSSLKQELSKKKKKGKLPKDARQKLLSWWELHYKWPYPSESEKVALAETTGLDQKQINNWFINQRKRHWKPSEDMQFMVMDGLHPQNAAALYMEGHYMGEGPFRLGQ

SEQ ID NO: 11630 - protein, 393 aa, Triticum aestivum
  unsure (1)..(393): unsure at all Xaa locations
ATPPTPRVGVKQGKGRVMWRRCICCQATEFDENENGRAKAKAPTNNVDGMKKGLKDSATVKAEPQDSAPSINIPVLSLDELIEKTDDFGAKALIGEGSYGRVYYAVLDDGTKMAVKKLDATENEPISEFSTQVSLVSRLKHENFVDILGYCMERNLRIVGAXNLRIVAYEFATMGSLHDVLHGRKGVQGAQPGPPLNWMQRMKIAVDAAKGLEYLHEKVQPSIVHRDVRSSNILLFEDFKAKIADFNLSNQAPDMAARLHSTRVLGTFGYHAPEYAMTGQLTQKSDVYSFGVVLLELLTGRKPVDHTAPRGQQSLVTWATPRLTEDKVKGCIDPRLEGEYPPKGLAKLGAXAALCVQYEAEXPSKXMXIVVKALSPLTLSRQTPPAPAAALDS

SEQ ID NO: 11631 - protein, 448 aa, Streptococcus agalactiae 2603V/R
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYVAWAGRNRSPLIRVPASRGMGTRLELRSVDPTANPYLALSVLLGSGLEGIENKIEAPEPIETNIYAMTVEERRQAGIVDLPSTLHNALEALEEDEVVKAALGTHIYTNFLDAKRIEWASYATYVSQWEIDNYLDLY

SEQ ID NO: 11632 - protein, 488 aa, Mastocarpus stellatus
MSNSVEERTRIKNERYESGVIPYAKMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRSVAASGEIKGHYLNVTAATMEEMYERAEFAKQLGSIIIMVDLVIGYTAIQSMAIWSRRNDMILHLHRAGNSTYSRQKIHGMNFRVICKWMRMAGVDHIHAGTVVGKLEGDPLMIKGFYNTLLLPYLEINLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADFVETPTANV

SEQ ID NO: 11633 - protein, 101 aa, Glycine max
  unsure (1)..(101): unsure at all Xaa locations
MAQFSGKTLVQWLVATLLIALLGGAQAVVLCSIDSSQLNLCRAAVTGQNPPPPDEKCCAVIRQANLPXLCRYKSILPLIGIKPEKALALPGKCGLQSPPNC

SEQ ID NO: 11634 - protein, 163 aa, Acetabularia acetabulum
WFQGTADAVRQQIRYVEEDKGDEVLILSGDQLYRMDYVPMIQMHRETGADATIAVIPIPTEETYGLGLAVSMTMAGSKGLSKTQDRGRACPGEDVGRLAEKRGVKDTNRQFLGNMGIYLFKKDSLLELLNAPPKATDFGKEIFPRCVDTHKVMTYVFEDYWED

SEQ ID NO: 11635 - protein, 333 aa, Prochlorococcus marinus subsp. pastoris str. CCMP1378
MKSILEQLSSITVVVADTGDLDAIKKFQPRDATTNPSLILAAAKNPDYIKLIDQALESSRKSLPAGFSESELIKETIDQVSVFFGKEILNLISGRVSTEVDARLSFDTEATVTKARKLINHYKSFGINKERILIKIASTWEGIKAAEILEKEGIKCNLTLLFNFCQAVACANAKITLISPFVGRILDWHKAKTGKDNFAGCEDPGVISVTKIYNYFKEKGFKTEVMGASFRNIDEIKELAGCDLLTIAPKFLDELNREEGELIKKLDEDTQSQSSIDYKFDEKDFRLSMLEDQMASEKLSEGITGFSKAIEELEELLLKRLSEINNQKLISTT

SEQ ID NO: 11636 - protein, 413 aa, Streptomyces avermitilis MA-4680
MHSAVLLIEFGAIILSLGLLGRAAARLRFSPIPLYLLAGLAFGEGGLLPLGASEEFVATGAEIGVILLLLMLGLEYTAGDLVSNLKAHYPAGLVDFTCNALPGAAAALLLGWGPVAAVVLAGVTWISSSGVIAKVLGDLGRVGNRETPVILSILVLEDLAMAVYLPIVTALVAGAGLAAGSVTLAVALAAAGLVLFVALRFGRLISRFVSSDDPEKLLLVVLGLTILVAGIAQQLQVSAAVGAFLVGIALSGEVAEGAHTLLSPLRDLFAAVFFVFFGLHTDPASIPPVLLPALALAAVTAVTKIATGYWAARRAGISVKGRWRAGGALVARGEFSIVIAGLAVTAGIEPSLGPLATAYVLLLVVLGPLTARYTEPLIARLNARSGRVRPEHRDAPVPTEPEGDTRAQTTVGD

SEQ ID NO: 11637 - protein, 399 aa, Bacillus anthracis str. A2012
MLANQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 11638 - protein, 397 aa, Malus x domestica
MEDYNNQMDHESSGGRGNFLYASPNLGGNYGRAASDHQMGINTFHLQSSGGGGGGGSGDQCNFQSPGTHPINVKTEATTSQHGHQKFQYNNNNNSHLVSSSRGHQPVIHQLQNNFDLLNDDHSLSSNEVEAIKAKIIAHPQYSNLLEAYMDCQRVGAPSDVVARLSVARQEFEARQRSSGTSRETSKDPELDQFMEAYYDMLVKYREELTRPIQEAMDFMRRIETQLNMLGNNNNAPPLRIFSPSEDKCEGIGSSEEEQENSGGETEVPEIDPRAEDRELKNHLLRKYSGYLSSLKQELSKKKKKGKLPKDARQKLLSWWELHYKWPYPSESEKVALAESTGLDQKQINNWFINQRKRHWKPSEDMQFMVMDGLHPQNAALYMDGHYIGDGHYRLGP

SEQ ID NO: 11639 - protein, 517 aa, Zea mays
MAMAAIASPSSRTLIPPRHHGAAPSPSTSGDSSLRLLRAHPRHGRRGRAVSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIAGYKNEGFVEVFAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 11640 - protein, 148 aa, Glycine max
MASKNSQQDTRLARIASAIRVIPDFPKPGILFQDITTLLLDTKAFKDTIDLFVERYRDQNINVVAGDEARGFIFGPPIALAIGAKFVPMRKPNKLPGEVISKEYSLEYATDKMYMHVVECACVIELPELKGRERLGDKSLFVLINGGA

SEQ ID NO: 11641 - protein, 213 aa, Triticum monococcum
MSMSCGLCGANNCPRLMVSPIHHHHHHHQEHQLCEYQFFAHGNHHHHHHGSAADYPVPPPPDNFDHRRTWTRPFHETAAAGNSSRLTLEVGAGGQHMAHLVQPPARAHIVPFHGGAFTNTISNEAIMTIDTEMMVGPAHYPTMQERAAKVMRYREKRKRRRYDKQIRYESRKAYAELRPRVNGRFVKVPEAMASPSSPASPYDPSKLHLGWFR

SEQ ID NO: 11642 - protein, 450 aa, Enterococcus faecalis V583
MSETQQTTLKKQLSSRHITMLALGGAIGAGLFKGSGEAIGIAGPSVLIAFLIGGAVLFIVMSGLGKLVLDGGDTHHGLSGLVRPFLGAHSADFIDWVYYSMWTINIIAEAVAAASFLQLWFPNIPAWFFVFILAILTTLINLYSVRLFAETEYWLAFAKISVIILLIIFGVYLVGQQMLGSGVFPTLQSITDHGGFAPHGMKGIVNSLLVVIYSYGGSELIAITVSEADDPKKAIPKAIRGVMGRIISFYIIPLFLLLIIFPWNTLAGTTVSPFVMVFEKMNIPFAADIVNFVIILALFSSINSGVYASSRLLYFRLKDKKGPMSKLGVLNKHQVPQRSVFFCASVLYLGVILSYFVGDELFGYLAGSLSYTVLLIWILISAAAFVLSLKRGSLFEKSINLLALIILGLIFIGILFTNSLGVTLLTGLLYFVIFFSYRKKNDSFLLSDES

SEQ ID NO: 11643 - protein, 89 aa, Glycine max
TRPPTRPRTRGRTRGRAGWGVMASHRSGETEDTFIADLSVGLSTGQIKTGAPCRSERLAKYNQLLRIEEELGDAAVYAGAKFRAPVEPY

SEQ ID NO: 11644 - protein, 157 aa, Brassica rapa subsp. pekinensis
YPEWQHVKVSSPPPGRWGHTLTCVNGSNLVVFGGCGQQGLLNDVFVLNLDAKPPTWREISGLAPPLPRSWHSSCTLDGTKLIVSGGCADSGVLLSDTFLLDLSIEKPVWREIPAAWTPPSRLGHTLSVYGGRKILMFGGLAKSGPLKFRSSDVFTMD

SEQ ID NO: 11645 - protein, 462 aa, Pseudopedinella elastica
GYWDATYTVKATDVLALFRITPQPGVDPVEATAAVAGESSTATWTVVWTDLLTACDIYRAKAYRVDPVPNTPDQFFGYIAYECELFEEGSLANITASIIGNVFGFKAVKALRLEDMRIPYAYLKTFQGPATGVVVERDRLNSFGRPLLGATVKPKLGLSGRNYGRVVYEGLKGGLDFLKDDENINSQPFMRWRERFLSYKEGITRASAATGEVKGSYLNITAGTMEDTYERGEYAKEIGTIVVMVDLVMGYTALQSSAIWARKNDMILHLHRAGNSTYARQKNHGINFRVICKWMRMAGVDHIHAGTVVGKLEGDPLMVKGFYNTLLNVKTEINLPQGLFFAQDWASIRKCMPVASGGIYCGQLHLLLNYLGDDVVMQFGGGTIGHPDGIQAGATANRVALEAMVLARNEGRDYLSEGPQILMDAARMCGPLQTALDLWKGISFNYTSTDTADFAETPTANR

SEQ ID NO: 11646 - protein, 384 aa, Nostoc sp. PCC 7120
MLPFIRSDLAQFNAYKPHPSSDTASAVPPQLDRLDTNESPYDLPPELKQKLAWTFQQVIESNRYPDGGHETLKSAIAEYVNESANISSLRFTAANISVGNGSDELIRSLLIATCLSGEGSILVANPTFSMYGILAQTLGIPVVSVSRNPDNFAIDLTAAQSAIEQTLNPPIRVVFVVHPNSPTANPLTANELRWLKSLSERILVVVDEAYFEFSQNTLVSELAQRPNWIILRTFSKAFRLAAMRVGYCVAHPEAIAILEKVRLPYNLPSFSIASALVALQNRAILLESIPQTLDERTKLINAFSQHPALAVAESAANFIFLRLKADSDNSSDTTLLNLHQQLKNSGTLVRQISGGLRITIGTPEENIRTLNHIQTALIKPELVG

SEQ ID NO: 11647 - protein, 242 aa, Desulfitobacterium hafniense
APTSRARSPATSPCSRAMAVLVDRTHPSADKIRPRAIVAEIESTLAAELDLQREGANASVLRRFWADSDDMYVPEVIWTHTSERALTLERVYGIPSDDIAALDAAGIDRRALAAKGVRVFYTQVFRDNFFHADAHAGNIWVDSDPARRNNPRFIALDFGIMGQLSDEDQYYLAENFMAIFNRDYRRIAELHVQAGWMPAHIRIDELEAATRAVCEPYFTRPLSEISLAEVLLKLFRTGKVTS

SEQ ID NO: 11648 - protein, 301 aa, Glycine max
MASISLLLALFVFFFLIATSLTESRKELRNKQETALQMLERSIHFSNRINPSRVVQISWQPRVFLYKGFLSDKECDYLVSLAYAVKEKSSGNGGLSEGVETSLDMEDDILARIEERLSVWAFLPKEYSKPLQVMHYGPEQNGRNLDYFTNKTQLELSGPLMATIILYLSNDVTQGGQILFPESVPGSSSWSSCSNSSNILQPVKGNAILFFSLHPSASPDKSSFHARCPVLEGDMWSAIKYFYAKPISRGKVSATLDGGECTDEDDSCPAWAAVGECQRNPVFMIGSPDYYGTCRKSCNAC

SEQ ID NO: 11649 - protein, 768 aa, Emericella nidulans
MADTALVDHSPHHPTKAPRLETASNVILIDNYDSFTWNVYQYLVLEGATVTVIRNDEISLEELIAKKPTQLVVSPGPGHPKSDAGISNAAIQYFAGKIPIFGVCMGQQCIHHSFGGKVDVTGEILHGKTSVLKHDGRGAYEGLPPSVIITRYHSLAGTHSTIPECLEVSSFAQLGEDADKTVIMGVRHKQFAVEGVQFHPESILTEHGQTMFRNFLKLTAGTWEGNGKDVAQGGNFTAAAPNPPKATKQVSILEKIYDHRRAAVAKQKTIPSQRPSDLQAAYELSVAPPQISFPDRLRQSAYPLSLMAEIKRASPSKGLIAEHACAPAQARQYAKAGASVISVLTEPEWFKGSIDDLRAVRASLEGLTNRPAILRKEFIFDEYQILEARLAGADTSYVIVKMLDTELLTQTLSLFQSLGMEPLVEVNTPDEMKIAVDLGAQVIGVNNRDLTSFEVDLGTTSRLMDQVPESTIRLCTMRYFWTKDVEAYKKDGVKAILVGEALMRAPDTAAFVAELLGGQSKKLPLQSRNSPLVKICGTRTEEGARAAIEAGADLIGIILVEGRKRTVPDDVALQISKVVKSTPRPTPYPTEVPQGDTDATSVDYFDHSATTLRHPTRALLVGVFLNQPLSYVLAQQQKLGLDVVQLHGSEPLEWSRLIPVPVIRKFGLDEFGIARRAYHTVPLLDSGAGGSGELLDQMRVKQILKSDDGLRVILAGGLDPLNVTEIIKQLDESGYKIVGVDVSSGVETNGVQDLDKIRSFVQAAKSAF

SEQ ID NO: 11650 - protein, 70 aa, Malus x domestica
QIMQIISDTNHYDIRKKCEGSLCYDFSNMETFLNKQPVRDALGVGDIEFVSCSTTVYDAMQNDWMRNLEV

SEQ ID NO: 11651 - protein, 495 aa, Bacillus subtilis subsp. subtilis str. 168
MSSLTMQVTKRLETFLQGTKKLYIDGKFVPSASGATFDTPNPATGETLMTLYEAQAADVDKAVKAARKAFDQGEWRTMSPASRSRLMYKLADLMEEHKTELAQLETLDNGKPINETTNGDIPLAIEHMRYYAGWCTKITGQTIPVSGAYFNYTRHEPVGVVGQIIPWNFPLLMAMWKMGAALATGCTIVLKPAEQTPLSALYLAELIDQAGFPAGVINIIPGFGEDAGEALTNHEAVDKIAFTGSTEIGKKIMSTAAKSIKRVTLELGGKSPNILLPDANLKKAIPGALNGVMFNQGQVCCAGSRVFIHKDQYDEVVDEMASYAESLRQGAGLHKDTQIGPLVSKEQHERVLSYIQKGKDEGAKAVTGGSCPFEAGYFVAPTVFANVEDEMTIAKEEIFGPVLTAIPYETVDEVIERANHSEYGLAAGLWTENVKQAHYIADRLQAGTVWVNCYNVFDAASPFGGYKQSGLGREMGSYALDNYTEVKSVWVNLED

SEQ ID NO: 11652 - protein, 461 aa, Synechocystis sp. WH 8501
MKTIPTPKTPTLVQQLQWVLNPTGYLQTNHHRYPDLFKAKIIGLGNDIILISNPEIMQYILTHDRQEFTAPSSLNTLLKPLLGDYSVVMLDGDGHRQRRQLVMPSFHGERLKVYGDLTCRITREAMEKLPENQPFLAREVMQDISLKVIMEAVFGVTEGERYEELQYRLKELLDLFDSPITSGFLFFPSLQKDLGNWSPWGYFLRQRQALDKLIYAEISDRRANPDPERTDILSLLMFAKDEQGESMKDQELRDELITLLMAGHETTASAMAWALYWLHHIPEIKDKLIEELNTLSPDAEGMDIFRLPYLTAVCNETLRLSPSAMLTFTRLAQQTVEVGGYTFKPGDIVAGCLYLTHLREDIYANPKQFNPQRFLDHKYSAYEFIPFGGGSRRCMGEALAKFEMKLVIAIIISEYCLKLADTQPEKQQRRGLTLSPKRGVKMILEGKRQPQKARELELSTR

SEQ ID NO: 11653 - protein, 107 aa, Escherichia coli
DPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 11654 - protein, 488 aa, Vaucheria dilwynii
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEIKGSYLNTTAGTIEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLDTKLEINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVETATQSK

SEQ ID NO: 11655 - protein, 429 aa, Grateloupia imbricata
DPDYVVKDTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPL

SEQ ID NO: 11656 - protein, 90 aa, Zea mays
  unsure (1)..(90): unsure at all Xaa locations
YVCKPTGEFILFSGSEHRPADRKRWMADLGADKLRVHQVVWPGTHDSGTNKIGVPLXTRPFAQCQSMSGYQQLAMGTRVVHVRVQEERRV

SEQ ID NO: 11657 - protein, 339 aa, Escherichia coli O157:H7 EDL933
MTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 11658 - protein, 129 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAM

SEQ ID NO: 11659 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKSQ

SEQ ID NO: 11660 - protein, 300 aa, Aquifex aeolicus VF5
MKTLFLIGLGRMGSALAYRLKNRGWEIYGYSRTQTTRERAKKDLGIKVLNSYENLKNFPSPKTVWLMVPHTAVDEVLQNLKPFLNKGDTVIDGGNSYYKDSQRRYRELKEVDVNFLDVGVSGGILGKDTGFSFMIGGDEEVFKKHEKLFKDLAYEEKGYAYLGSSGAGHFAKMVHNGIEYGIMEAIAEGFELLKKSPFDYDLREVARVYSQGSVIRSFLIDLLVKAFEDFGDLEDVEGYVEDSGEGRWCVKESVELGAPIPVIAQSFYERFSSREKDLFKNKVLAVLRYEFGRHRVKKKD

SEQ ID NO: 11661 - protein, 515 aa, Oryza sativa
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSVDRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 11662 - protein, 182 aa, Pseudomonas aeruginosa PAO1
MIFDEFTLKSQIRAVPDFPKPGVVFRDITPLFQSPRALRMTVDSFVQRYIEADFSHIGAMDARGFLIGSAVAYALNKPLVLFRKQGKLPADVLAEGYQTEYGEAFLEVHADSLCEGDSVLIFDDLIATGGTLLAAASLVRRLGARVFEAAAIIDLPELGGSTRLQDAGISTFSLTAFALDER

SEQ ID NO: 11663 - protein, 753 aa, Methanosarcina barkeri
MASVETTERLGCSLGFFSTFAIGTGTMIGAGIFVLPGIALADAGSGAIISFLLGGLISIATAISMSELATGMPLAGGSYYYISRTMGAALGAIIGLGSWLALIFKGTFALIGLAEYAQIFYPLPLYFVAAATGVILLVINYRGAKSSGSLQNFIVIFLLVILALFIARVSFMVNPANLSPATSYGGTSIITTAGVIFISYLGLAEAAAVSEEVKNPSKTLPLAFIASAVVVTLFYVSTMAVVVGFSDPQVTGKSITPLADIAGLLAGESGRIAISLSALLATLSTANGAILSSSRFPFAMSRDALMPEWFVLIHQKFETPHNAILVTGIVMVLLLFLFDIEELARLGGAFNILIFILLNMAVIILRKRNLPGYEPTFRDPFFPYTQIFGIVGSIVLLPLLGGLPLLFTIMMIFAGIGWYSFYGRGKAVPEYNLFDLLENTVEKKEIEPVPLVKVLVPISNQKHERDLLKLADFMGSEIICLHVIEVPDQTNLKLAQEAYHEKKIEMDCRFKEEFENYPAILGHKREYIAAFDHNISNSILEQAEIEHADMIIMGWHEPKRFEYSHGVTNQVLLSSKSPIALLKGHLPDSINKILVGYNGKENSIYGLSLAEKLAVNTGAGIEIISIISPDEAQENRQKITDELESLVKKISSIPVSFRVLEKYSIEDALLEASNNNDLTIIGDSSERFKISLLGTLSQRIAKHSKKPIVVVKKSKPISKESFNYLVKKHARKIYARLRGKEVKLNSDKSAVLA

SEQ ID NO: 11664 - protein, 222 aa, ASPERGILLUS NIDULANS FGSC A4
MSNPLDTDAGSEMLSSYETELNLVQADLNQKLDQIAELSGEQRNSTIRQAERALEEATELLDQMRLEKQNIPSAARSKVNTRFRNYATDIDEAKRKLKSLSDDRKALFGDRYTDDPQDAHLEQRQQLLSGTERLERSSARLRESQRIALETEGIGANVLADLHQQRETITHTHGMLGQSESNVDKSIKTLKGMAPRHRVRAGFGSDSLEHIDFLLTTVVERV

SEQ ID NO: 11665 - protein, 267 aa, Arabidopsis thaliana
DVRKALEDYGCFEASFDKLSVELNRSVFEAMEDLFELPIPTKQRNVSSKPFHGYLCHNLYESLGINDANVLEKVNDFTQQLWPDHGNKSISETIHRFSEKLVELDLMVRRMIMESFGIENYIDEHLNSTYYLTRLMKYTSPPDDDDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 11666 - protein, 242 aa, Oryza sativa
MRRARVPISRFPVGAVGLGMSGCIYASVNLEFRGLPLSHSIHAEQFLVVNAAAVGKSKLCAIAISHMPCGHCRQFLQEIRGAGGIRIIVTSSDAKWRTVSSLLPRPFGPHDLLPKHVPLVLKPHDSPLVGNPATAVITNGFANGDLEARLREAAEAAARAAHTPYSECPSRFAVADGEGPMQAAIIGMVAAGGAAAAEDVVAAALVEKEAALVSQEAMARIFLAAVAPQASFHVYNFGLSDA

SEQ ID NO: 11667 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKTIGAEQAEKTRILYGGSVNGKNAKDFKDKANVDGFLVGGASLKPEFVDIIKSRL

SEQ ID NO: 11668 - protein, 346 aa, Solanum tuberosum
MRTSMLKSIVRRSSTAGASYVSRRGFASGSAPERKVAVLGAAGGIGQPLSLPMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 11669 - protein, 335 aa, Staphylococcus aureus subsp. aureus N315
MSYIIIVTIAVVIFSLIFDFINGFHDTANAVATAVSTRALTPKTAILMAAVMNFIGALTFTGVAGTITKDIVDPFKLENGLVVVLAAILAAIIWNLATWFYGIPSSSSHALIGSIAGAAIASEGSFGVLHYQGFTKIIIVLIVSPIIAFCVGFLMYSIFKVIFKNANLTRANRNFRFFQIFTAALQSFSHGTNDAQKSMGIITLALIVANVQNDGSVEPQLWVKFACATAMGLGTAIGGWKIIKTVGGNIMKIRPANGAAADLSSALTIFVASSLHFPLSTTHVVSSSILGVGASNRAKGVKWSTAQRMIITWVITLPISALLAGLLFYILNLFF

SEQ ID NO: 11670 - protein, 371 aa, Triticum aestivum
MARRSAPLLRRLVSSAPPLPGHGGGARRTVTYMPRPGDGTPRPVTLIPGDGIGPLVTGAVEQVMEAMHAPVYFESYDVHGDMPAVPPAVIESIRRNKVCLKGGLATPVGGGVSSLNMQLRKELDLFASLVNCANVPGLPTRHQNVDIVVIRENTEGEYSGLEHEVVPGVVESLKVITKFCSERIAKYAFEYAYLNYRKKVTAVHKANIMKLADGLFLESCREIAAKYPSIEYNEIIVDNCCMQLVSRPEQFDVMVTPNLYGNLVANTAAGLVGGTGVMPGGNVGQDHAIFEQGASAGNVGNDNLVEQQKANPVALLLSSAMMLRHLQFPSFADRLETAVKRVIAEGKYRTKDLGGTSTTQEVTDAVIANLD

SEQ ID NO: 11671 - protein, 298 aa, Saccharomyces cerevisiae
SIPETQKLEYKDIPVPKPKANELLINVKYSGVCHTDLHAWHGDWPLPTKLPLVGGHEGAGVVVGMGENVKGWKIGDYAGIKWLNGSCMACEYCELGNESNCPHADLSGYATADAVQAAHIPQGTDLAEVAPVLCAGITVYKALKSANLMAGHWVAISGAAGGLAKAMGYRVLGIDGGEGKEELFREKDIVGAVLKVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 11672 - protein, 171 aa, Triticum aestivum
QCIRRATEFDGKLQNEDGSWFGSWGICFTYGTWFAIEGLSAVGQCYNNSTYIRKGCQFLLSKQLRNGGWGESHLSSTTKAYTNLDGEKSHVVNTAWAMLALMKAGQAERDPSPLHEAARLIMSMQLGNGDFPQEEMIGSFLKNGPLCYMAYRNIFPIWALGEYHRLVLCSG

SEQ ID NO: 11673 - protein, 258 aa, Clusia minor
CEEIGRGRFGVVYKCTKLSTNETYALKSIVKNSLNDDLLDARCLVTEPKILRHVSPHPHVTQLHDSHEDDCYLHLIIDLCPNGDLYTLLLSTGPIPEAQSKAQFVQLMKAVSHCHKSGVVHRDIKPDNILFDSRESLKLADFGSAECGKGSDLNGVVGTPYYVAPEILEGREYGEKVDVWSAGVVLYVMLAGFPPFYGETVVEIFEAVLRGNLRFPTRAFCTVSSSVKDLLRRILCRDVSRRFTADQVLRHPWVTSGG

SEQ ID NO: 11674 - protein, 492 aa, Ricinus communis
MDPYKFRPSSSNDTPFWTTNAGDPVSNNNSSMTVGPRGPILLEDYHMIEKLANFTRERIPERVVHARGMSAKGFFEVTHDVTDLTCADFLRAPGVQTPVIVRFSTVIHERGSPETLRDPRGFATKFYTREGNFDIVGNNFPVFFIRDGIKFPDVVHAFKPNPKSHIQEYWRIFDFCSHHPESLSTFAWFFDDVGIPQDYRHMEGFGVHTYCLINKAGKVTYVKFHWKPTCGVKCLMDDEAIKVGGANHSHATQDLYDSIAAGNFPEWKLMIQTMDPADEDKFSFDPLDMTKIWPEDMFPLHPVGRLVLNRNIDNWFAENEMLAFNPAHVVPGVYYSNDKLFQLRLFAYSDTQRHRLGTNYLQLPVNAPKCPYHNNHYDGFMNFMHRDEEVDYFQSRYDPVRHAEKVPIPNAICSGRREKCVIEKEDNFRQPGDRYRSWAPDRQERFLCRLVNALSEPRITHEIRSIWVSWWTQCDKSLGQKLASRLNVRPNI

SEQ ID NO: 11675 - protein, 150 aa, Chlamydophila pneumoniae CWL029
MQLLSPAFAYGAPIPKKYTCQGAGISPPLTFVDVPGAAQSLALIVEDPDVPKEIRSDGLWIHWIVYNLSTTITNLAEGAEIFAVQGLNTSGKPVYEGPCPPDKQHRYFFTLFALDVVLPEEENVTRDQLYEAMEFHIIEQAELMGTYEKS

SEQ ID NO: 11676 - protein, 706 aa, GIBBERELLA ZEAE PH-1
MPGAFGPEDYIDFYENPLEVLDNLESAWKNREPRITWSTNNLPTLDDVDFDWRTYNPPGALRRAPNITSQVLLDILQSSVQNVEERNIEEDRQKKEADAQRQLQENEKGKNKEPYLPIIIPIEKLVQDDTSKDVPKIKPDILMTTFGPSVTVTKNGAKANKKRLVALRRFFQRSEEKGESSATGAVLMALREEAGETEPGSENLVRLTKPDTIEEVECVSCLDDFHPKDVIKVPCHSYCHDCFIRLVSAACQNEQQWPPKCCLNEVPVKIVLRFIPSNLKKTFEERSKEWELPVSERVYCSEPNCSLWIKPKRIDLSRRRGVCDRSHRTCTLCRGPAHQGEECPQDVDMTLTNQLAEEEGWKRCSKCHALVEHREACQHMTCRCGNQFCYVCERRWRTCDCTMEHLQAVKDGAAARREERRVNELAEAEEIRQALLQIEEFEREEALKAELLRQEQERLEEERRQRELEERARQESIRRRDIEIKYHELRISLDQLHELQQVLLEIDQETEGEDMVIGIESAKDSLEKKHESERSELKITISKKMAEKEDALNKDFQIRAAQENDLEQAYHERLKAYWKDRKDGDEEIENAMLDLRKRMDQKQYAWQKWKAEQLKDLEVKLQDNETYREELMYSAKHRLDDSCKEKEREMVRRMAAENKWLEAVVLEREKLLSEWEYDEVEGDADSIFAPESDGSGDGNYIVGTAS

SEQ ID NO: 11677 - protein, 250 aa, Schizosaccharomyces pombe
MVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGYLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 11678 - protein, 473 aa, Oryza sativa
  unsure (1)..(473): unsure at all Xaa locations
HCDTRSRAKRYHPPIHGGLHLRHLLLHSHQARLLLLLLLKSQLRLLRQXSGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 11679 - protein, 122 aa, Emericella nidulans
NDTTGTLIASSYTDPAMKIGCIFGTGVNAAYMENAGSIPKLAHMNLPPDMPVAINCEYGAFDNEHIVLPLTKYDHIIDRDSPRPGQQAFEKMTAGLYLGEIFRLALVDILDTQPGLIFKDQD

SEQ ID NO: 11680 - protein, 246 aa, Malus x domestica
MGRGRVELKRIENKINRQVTFAKRRNGLLKKAYELSVLCDAEVALIIFSNRGKLYEFCSSSSILKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 11681 - protein, 406 aa, Clostridium perfringens
MKKFIALEEALEILNKNTKALKSEVVSIKDSLKRVLYGDVKSKINNPPFNKSVFDGYAFKSEDSKGTSKENPIELKIVDEIFAGDFSEIEIKHGEAIRIMTGAPIPVGADCVLKQEETERHGDLVKIFKEMKANENISFMGEDIKIGETLIKKGKRLDYADLGIMASSGISEVLVYKKPKVSIISTGDEVCDINSTLKPGKIYDSNLYSLSARIEELGYNVLSMEHVGDNILKIGEAIEKAFEKSDIVFTTGGASVGEKDLMQKVSGSIGFERLFWKIKIKPGSAVVCSKRQEKILISLSGNPNAALTTFELLGKPVLKKLEGEEENINIKREKGVLMDSFNKKSPQRRFLRGNIIYDEKGAKVYITQIKSGNGILSSLLNANCLIEIEKGNEGLNRGEVVNIIKL

SEQ ID NO: 11682 - protein, 347 aa, Glycine max
MLDGEATMGTWARMCDTCRSAPSSVFCRAHTAFLCATCDARLHASLTWHERVWVCEACERAPAAFLCKADAASLCASCDADIHAANPLASRHHRVPILPIAAAPGNNDNDNVDDADLDDDDETASWLLLNPVKSASVPNNNNTNNGFSYNGEVDEYLDLVDDCDNHHFASAAATTDHYAQHQHFAGVSQKSYAGDSVVPVQQHQHFQLGLEFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 11683 - protein, 521 aa, Oryza sativa; identical to SEQ ID NO: 8508

SEQ ID NO: 11684 - protein, 401 aa, Zea mays
  unsure (1)..(401): unsure at all Xaa locations
MEAPPGPGPMELDAPPPAAAAAIPPAGSDKHKVDGEGGDAVTGHIISTTIGGKNGEPKRTISYMAERVVGTGSFGIVFQAKCLETGETFAIKKVLQDRRYKNRELQLMRAMEHPNVICLXKHCFFSTTSRXELFLNLVMEFVPETLYRVLKHYSNANQRMPLIYVKLYMYQLFRGLAYIHNVPGVCHRDVKPQNVLVDPLTHQVKLCDFGSAKVLIPGEPNISYICSRYYRAPELIFGATEYTSSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRTPNARLPNGRPFPPLFNFKHELANASPDLVSRLVPEHIRRQIGVNFGSS

SEQ ID NO: 11685 - protein, 232 aa, Saccharomyces cerevisiae
MDRKAVEEKRIVISIGGGHATGVGAIALDLQNTFKSLYNSINIRVINLDNMIEGNIKSYNNNDYDFDNILNLVYEKHAVTSQNDMIQHDYEDPIDLIIVCGCYALYDKRINEISQLKVFLDSDADKRLISLIKKKNVGSNEQLAQLITEYMDHLRPEMQQYIEPTRTFADLIIPSTNENLGRAVLVDGIVKAIEDTKSQIEGNNTNNKIRPRLWDFEAETMDLEKDRYYDLS

SEQ ID NO: 11686 - protein, 327 aa, Zea mays
MDAGKVAELRRVDLRGLRPGGPGWVQACAAVAASMEELGCVVVAHGALDGELRRDLFGRAMPELFALPLPAKQGTLSGHIGGYIGPDPEKAPGLESLRISEATDAGKVHAFADLVWPDDGNAAFCQTIGAFAKGMLELDHAVQKMVLESLGVRKERVDSHLASLVYDVRLSRYGALAPVTAGDDDEATTYMVAHRDCSMVTTITQHEVEGLQVRGRDGAWISVAPEPGTFAVVAGEMLTVVTNGRVPACVHRVRTPSNRERLSVLFGSSLKHGAVVSALEELVDHGRHPLRFRPCDFDEYVKFRFGQERPGLNSALQEFCGIGTGTK

SEQ ID NO: 11687 - protein, 559 aa, Trichodesmium erythraeum IMS101
MLTKNSSKSRPWQRAQYSPLTRQIDVFSAAGKFFFFLWWDNLFQNKSSTLRRRRAEWLVKTMINLGPTFIKIGQSLSTRADILPKEYVEELGKLQDQVPPFETTEAIAIIESELGNSLYSLYRDFKEFPIAAASLGQVHKANLQTGEEVVVKIQRPGLKVLFDLDVKALKNVIRFCKRYFAWAKKYDLDVIYYDFFTILYQEIDYVNEGKNADRFRDNFQGYPDIVVPRVYWTHTTEKVITLEYLPGIKINDRREMEAYNLNPKLINQIGVCCYLKQLLLDGFFQADPHPGNLAVSSDGKVIFYDFGMMAEVKSLTKDQMIKTFFAVLKKDVEQVLNALITIGLIVPMSNMMPVRRLLDFLLENFTDKPVNFYDFDQIKEELYVLFEEQPFRLPSQMTFILKSLTTLDGIARELDPDYSLVSCSQPFVKSITFSKGKGRVVGELAKQTTDFIKYKLRQPSKSEVLIRQFQTKIEDGEIQFRVRSIEHDRLLKRINLALKVLIFTGFTGFTFLSGSVLLTGGYIKAAIIIFVLSVLGFIFLLKLGFQLSIKEKLDKIAEK

SEQ ID NO: 11688 - protein, 247 aa, Zea mays
  unsure (1)..(247): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQEXTRRGLELLKTAIEKAGYTRQV

SEQ ID NO: 11689 - protein, 470 aa, Gelidium pulchellum
  unsure (1)..(470): unsure at all Xaa locations
GVIPYAKMGYWDPDYAVKETDVLALFRVTPQPGVDPVEASRAVAGESSTATWTVVWTDLLTACDLYRAKAYKVEEVPNSSDQYFAYISYDIDLFEEGSIANLTASIIGNVFGFKAVKALRLEDMRIPVAYLKTFQGPATGIIVERERMDKFGRPFLXATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 11690 - protein, 169 aa, Zea mays
IHRVHVCLSHPLRANPHPTEFQRAVIRWMLDDGSGRPGFVAESTGHQASSRLLSMKSVNAMLEVPSTGQILAAGTSIQAILISDIITSLDKLPAPSNPHPSRFGSFAESIFTDISQIASPQDAEVKVAILTLSDTVSSGAGPDRSGPRAVSVVNSSSEKLGGATVVATA

SEQ ID NO: 11691 - protein, 228 aa, Zea mays
MAGTSSWSSSSSCASSFGSPDHDVVCVTEPDSVGAAGAVADAEGSVKFLCSYGGRILPRRTDGTLRYVGGDNRVLSVDRPIRFYVLQRKLRELCGGWEAHLRCQLPTEDLDALISVTCDDDLAKLLEEYDEASKDRLQSLKIRAFLFPTRTPAPSILQRRSPPSIAHLHWQNTSPPPAAAGVSLTCAPRWWAAPQASRQAQAPQAQNYDRHSLGEERPRLYYSYMPRT

SEQ ID NO: 11692 - protein, 460 aa, Hypoglossum sp.1
WDPNYVIKETDVLALFRVTPQPGVDPVEASAAVAGESSTATWTVVWTDLLTACDLYRAKAYKVDAVPNTSDQFFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQSMGIWARRNDMILHLHRAGNSTYSRQKIHGMNFRVICKWMRMAGVDHIHAGTVVGKLEGDPLMIKGFYDTLLLPYLDINLPLGIFFQQDWAALRKVTPVASGGIHCGQMHQLLDYLGDDVVLQFGGGTIGHPDGIQAGATANRVALESIVIARNEGRDYVAEGPQILRDAAKTCGPLQTALDLWKDITFNYTSTDTADFVETPTANV

SEQ ID NO: 11693 - protein, 338 aa, Glycine max
QIIPWNFPLVMFAWKVGPALACGNTIVLKTAEQTPLTALFVAKLFHEAGLPDGVLNVVSGYGPTAGAALASHMDVDKLAFTGSTDTGKVVLELAARSNLKPVTLELGGKSPFIICEDADVDKAVELAHFALFFNQGQCCCAGSRTFVHERVYDEFLEKSKKRALRRVVGDPFKKGVEQGPQIDVEQFEKVLRYIRSGIESHATLECGGDRLGSKGFFVQPTVFSNVQDDMLIAQDEIFGPVQSILKFKDIDEVIRRANKTRYGLAAGVFTKNVSTANTLMRALRAGTVWINCFDVFDAAIPFGGYKMSGIGREKGIYSLHNYLQVKAVVSPVKNPAWL

SEQ ID NO: 11694 - protein, 191 aa, Chlorobium tepidum TLS
MMSRSIQNPLAALVALLMLMPVMLRAGQKGEAMTFELTSTAFRNMGAIPALYTCEGKNISPPLTWKNIPKGTKSLVLIVDDPDAPDPAAPKFTWVHWVLYNIPPGKTGFAEGAGNHPAETEMQEGFNSWNRGGYGGPCPPIGTHRYFFKLYALDTVIDDLLSPLKADVEAAMQGHILGETVLIGTYKKRGK

SEQ ID NO: 11695 - protein, 390 aa, Lactobacillus plantarum WCFS1
MRREQVSAIINLLEPSDALQPLTAVRPVGMLPFGGRYRLVDFQLSSVINAGIQNVMVTVPRSGRSVADHLRSGRDWSLNTIRGGLFLSPYNDLKLVAPEKKAALLHHYYDNSIQFLKCSQSEYSVVMSTRNVGNIDLKALLRYHEERNSPVTAVYKRVDPASLIPENTILQLTAKGEATAVVPMSKAKISPKTKQVAKSMAIYLMSTVDLIELLQSANQRGDMISLEELMRQAVIQHNANAFEYTGFQANIHDINSYFAANMAVLDEANFRALFYSSRRIYTKVKNEIPTFFATGSQCRDSLCGTGGYIEGQLDHSVIFRDVLINRDSQVKNAIIMQGARIGAGCKLENVIIDKDAVIGPNLVLKGTSTTPLVISKGQHVFQQAEVAVHD

SEQ ID NO: 11696 - protein, 612 aa, Spirulina platensis
MQLQTKIAAKRATGAFRLIDSLKRHGVQHIFGYPGGAILPIYDELYRAEAEGDIQHILVRHEQGASHAADGYARATGRVGVCFGTSGPGATNLVTGIATAHMDSIPMVIITGQVARPAIGTDAFQDSDIFGITLPIVKHSYVVREPGDMARIVAEAFHIASTGRPGPVLIDVPKDVGLEEFDYIPVNPGEVSLPGYRPTVKGNVRQINQAIKLIEEAERPLMYVGGGAISATAHAEIAELAELFQIPVTTTLMGKGSFDEKHPLSVGMLGMHGTAYANFAVSECDFLIAVGARFDDRVTGKLDEFGSRAKVIHIDIDPAEVGKNRTPEVPIVGDVRQVLIHLLRRCREIGDVGNDNQTQSWLERINRWPEDYPLVVPSYSDSLSPQEVIAELGKMAPDGYYTTDVGQHQMWAAQFLKNGPRQWISSAGLGTMGYGIPSAMGAKVALERSQVICIAGDASVQMNIQELGTIAQYGINVKTVIINNGWQGMVRQWQQAFYGERYSASNMEIGMPDFEMLARSYGVKGMVVKSRDELHQALAEMLAYDGPVLMDVHVTKDENCYPMVAPGRSNAQMIGLPERRQLEKAVELIYCSNCGAKNVASNNFCPECGDKL

SEQ ID NO: 11697 - protein, 271 aa, Parmotrema chinense
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKKTMKEASEGPLKGIMSYSEDALVSTDLNGDNHSC

SEQ ID NO: 11698 - protein, 521 aa, Corynebacterium glutamicum ATCC 13032
MIKRLPLGPLPKELHQTLLDLTANAQDAAKVEVIAPFTGETLGFVFDGDEQDVEHAFALSRAAQKKWVHTTAVERKKIFLKFHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINQAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 11699 - protein, 454 aa, Asparagus officinalis
MGPPDVVPSEHVEFDFSDVFGPSPTPTSTGVNVFASDGSTPAASDDIVYTEPAVILARSHSLVGPTALVCQSPRLRKHILHEADLELVECPSGVEGEQDKPFSCVAEEHEVPSSENVERVGLEDFDFLKVVGQGAFGKVFQVMKKGTSEIYAMKVVRKDTILEKNHSEYMKAERDILTKIDHPFIVQLRYSFQTKYRLYLVLDFVNGGHLFYQLYHQGLFREDLARIYTAEIVSAVSHLHANGIMHRDLKPENILLDADGHVMLTDFGLAKEFEENTRSNSLCGTIEYMAPEIIQGKGHDKVADWWSVGILLFEMLTGKPPFIGGNRDKIQQKIVKDKLKLPAYLTSEAHSLLKGLLQKEASKRLGGGPAGSNEIKNHKWFKLINWRKLEAREIQPSFKPNVAGKICVANFEERWTSMPLTVSPVASPVAGSGNFSGFTYVKPSVFLQKPSPLG

SEQ ID NO: 11700 - protein, 352 aa, Arabidopsis thaliana
MFRSMLVRSSASAKQAVIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQVSSHFLSTQTVATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 11701 - protein, 126 aa, Zea mays
  unsure (1)..(126): unsure at all Xaa locations
GYLEAGRGTALENGPIIXEMDTYRYHGHSMSDPGSTYRTRDEIAGIRQERDPIERVRKLMLVHEFATAQELKDMEKEIRKQVDAAIAKAKECPLPDPSELFTNVYVNDCGLESFGVDRKEVRTVLP

SEQ ID NO: 11702 - protein, 128 aa, Glycine max
  unsure (1)..(128): unsure at all Xaa locations
VCSMISSPAVTTVNRAGACMVAPFTALKSMVGFPWRKTTIDITFVAINGGXVQCMLVSPPIANKKFETLSYSPYLNDAQLLYEVKYHLKTGWIPCSQFDTDHGLGYHDHNRAPGYYYGLYWTMWKLPM

SEQ ID NO: 11703 - protein, 185 aa, Zea mays
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 11704 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 11705 - protein, 374 aa, Burkholderia fungorum
MKKRAWVLDDPGQPPRIGEGDTGRHVINVRRKVMAQLMKAAVVHEFGAPLRIEEVPVPQVGRGQILVNIKASGVCHTDLHAADGDWPVKPTLPFIPGHEGVGYVAAVGEGVKHVKEGDRVGVPWLYTACGHCEHCLGGWETLCQEQQNTGYSVNGAYAEYVVADPNFVGHLPAAVSFEDIAPILCAGVTVYKGIRMTDARPGQWITISGIGGLGHVAVQYAIAMGLRVVAVDISEDKLALARELGATLAFNASECDPAAAIQKEIGGTHGVLVTAVSRSAFAQALGMVRRGGTVALNGLPPGDFPLPIFSTVLNGITVRGSIVGTRQDLQESLEFAAQGRVRARIHLDRLDNINHVLAELKSGKVDGRIVLNLD

SEQ ID NO: 11706 - protein, 382 aa, Yersinia pestis CO92
MSQSNNVTDLARANIRALTPYMSARRLGGNGDVWLNANEYPLGTEYQLTTQTFNRYPECQPKHVIERYAAYAGLPPEQVLVSRGADEGIELLIRAFCEPGQDAILFCPPTYGMYAVSAETFGVERRTVPAQADWQLDLPAIANNLEQVKVIYVCSPNNPTGNLINPADLQAVLALAQGRAIVAIDEAYIEFCPQASVSNWLKDYPNLVILRTLSKAFALAGLRCGFTLANSDIIQLLLKVIAPYPLSTPVADIAAQALSPKGIEQMRQRVSEVRANRAWLQSALQDCACVEQVFTSESNYLLARFTASSSVFNALWDQGIILRDQNKQPGLANCLRITIGTRQECERVIAALAPLPGIDNSNNIDNQNKTYSQTSSIRKGTI

SEQ ID NO: 11707 - protein, 499 aa, Corynebacterium efficiens YS-314
MRLWGAGGLAEAMSTENFVSNQIFINGWVDGTSERSTTTLNPFNGEEVATIRNASQEDVDKAYATAAEVQKEWAAVPPVKKARILNKAAQVIEDNRDAIVELIRRESGSTALKANIEAGLAMASLREAATFPARITGQILPSNTPGKSNYVFREPLGVVGVISPWNFPFALSMRSVAPALACGNGVVLKPASDTPIVGGTLLAHIFEAAGLPTGLFNVVVGAGSEIGDYFVEHRIPRLISFTGSTPVGKQVGATATGGKYIKKVALELGGNAPMVVLSDADINKAVAAASMGSFLHQGQICMAVNRIIVEAPVYDQFLEGFAARVSKVAYGDQLDDATMVGPIVNDSQVESVSGKIDLAREQGARAVVSGPIEGRVIAPHVFADVTPDMELFREEIFGPVVGVVKADNEEHALELANDTEFGLSSAVFTEDLQRGINFARRVEAGMTHINDITVNDEAHVMFGGEKNSGLGRFNGEWAIDEFTTDHWVSVTTGTDAYPI

SEQ ID NO: 11708 - protein, 437 aa, Prochlorococcus marinus subsp. marinus str. CCMP1375
MAIPSVNGGHRRSKAFLFLICCALAGSLPHCMKQPQSFFPALTLAFLLGIYAFRVVLRGRSNFKNLLTVSNDILEIDDDLPFVDVIVSARDEEAVVGKLVQRLAAMQYPKEKIQICIIDDGSQDKTSLILQELNKQFSNLKVISRSRKSGGGKSGALNQALKKVHGEWVFILDADADFNDEILLKLVPFAKEGRWAAVQLRKAVVNSQQNLLTCCQAMEMAMDTVIQQGRQSIGGVVELRGNGALLNRQALDKCGGFNEGTVTDDLDLSFRFLLSGGLIGILWDPPVYEEGVETLGPLMRQRKRWAEGGLQRFFDYWPLLISRRLNSAQHLDLTAFFLLQYVLPVISFFDVITFLITKTIPVYWPLSIVAFSISGLAFFSGCRRSSFGPKIPNPTPFHLIISIIYLSHWFFVIPLITIKMAFIPKKLVWVKTMHKGN

SEQ ID NO: 11709 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTNINVLSNASCTTNCLAPLAKVINDKFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 11710 - protein, 274 aa, Campylobacter jejuni subsp. jejuni NCTC 11168
MLQTCIFPAAGYGTRFLPATKTLPKEMLPILTKPLIHYGVDEALEAGMENMGFVTGRGKRALEDYFDISYELEHQISGTKKEYLLDEIRSLINRCTFTFTRQNQMKGLGDAVLKGRPLVGDEAFGVILADDLCVNEEGLNVMAQMVKIYEKYRCTIIAVMEVPKEQVSNYGVISGNFVEENLIMVNSMIEKPSPDEAPSNLAIIGRYILTPDIFGILENTKAGKNGEIQLTDALLTQATNGMVLAYKFQGKRFDCGSVEGFVEATNYFYEKSKC

SEQ ID NO: 11711 - protein, 443 aa, Nitrosomonas europaea ATCC 19718
MQTYTPYSEAMVFSMLEHAHAAHLAWRQVPLHERTALLLKLADVLRENSESYARLMTEETGKTIRAARAEIEKCAWACEIYADKAAAWLAEEEIAADGIKHRVVIEPLGVILAVMPWNFPFWQVMRFLIPALLAGNGALLKHATNVTGSALKIQEAVNEAGFPKGLFVTLLVSHTVVEQVIAHPLCQGVSLTGSAEAGRAVASVAGRHLKKVVLELGGSDPFIVLGDADIPAAAKAAVIGRFQNNGQSCIAAKRLIVLKEIEEVFTSTLLAEVEKLVVGDPLDEATDIGPLVSEQAAETMEQFVLDAVAKGAMVRTGGTRKGAYFTPTVLTGVHSAMEVMTQEVFGPVLPVITADTVEEAITLANATRFGLGASVWSRDLEKGEQVARQLAAGATFVNSITKSDPRMPFGGIRESGLGRELSYWGVREFANIKTVNVYGGEEV

SEQ ID NO: 11712 - protein, 295 aa, Agrobacterium tumefaciens str. C58
MVEQKKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPEIFDILENQERGAGNEIQLTDGMLTLAKSQEFSGYHFRGQTFDCGAKDGFILANVAFALERGDIRPAIEEPIKALIEGLK

SEQ ID NO: 11713 - protein, 414 aa, Zea mays
MATGPVVHPQPVRGDPIDLKNAAAKNRRALGDIGNVDSLIGVEGGKLDRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLIDCSKLLAFIHSKAGESKLRGVLKKYSKLGRGAVALISPAKSLMSSAP

SEQ ID NO: 11714 - protein, 357 aa, Glycine max
  unsure (1)..(357): unsure at all Xaa locations
PLVLNLREELFTQPYDENSWKKARHKCAKEDLYYPHPWIQDLIWDSLYLFVEPLLTRWPLNKLIREKALQVTMKHIHYENENSRYLDMACVEKSLCMLACWVEDPNGDAFKKHLARIPDYFWVSEDGMIVQPVIGSQAWDIGFIVQALLATDLIEEFGPTLAKAHDFIKKSQLTDNPLXDCKSMYRHISKGAWTLSHRDDGWQVSDCTAEWLKWCLLLSLMPQEIVGEKMEPEKLYDSVDFILSLQSKNGGIPAWEPTISQKWLEXSAIQSLVFFKSLYPEYRKKEIENFINKAVQFLEDEQSTDGSWSGKWGVYSTYSSWFALRGLAAAGKTYTNCVTIRKAVKFQLPIQTENGGW

SEQ ID NO: 11715 - protein, 276 aa, Mycobacterium tuberculosis H37Rv
MEGFAGKVAVVTGAGSGIGQALAIELARSGAKVAISDVDTDGLADTEHRLKAISTPVKTDRLDVTEREAFLAYADAVNEHFGTVNQIYNNAGIAFTGDIEVSQFKDIERVMDVDFWGVVNGTKAFLPHLIASGDGHVINISSVFGLFSAPGQAAYNSAKFAVRGFTEALRQEMALAGHPVKVTTVHPGGVKTAIARNATAAEGLDQAELAETFDKRVAHLSPQRAAQIILTGVAKNKARVLVGVDAKVLDLVVRLTGSGYQRIFPIITGRLIPRPR

SEQ ID NO: 11716 - protein, 92 aa, Triticum aestivum
  unsure (1)..(92): unsure at all Xaa locations
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 11717 - protein, 315 aa, Synechococcus sp. PCC 7942
INGFGRIGRLCLRAGFDDPQLDFVAINDLVPPKNLAYLLHYDSTHGRLQQTVRAEEDRICAGDRCIQCFSETDPAAIPWGELGVDVVIEATGRFTDYRAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNE

SEQ ID NO: 11718 - protein, 443 aa, Enterococcus faecium
MEKPAMKRTLTNRNIQLIALGGAIGTGLFLGSAKAIASAGPAVILVYLICGLAIYGLMRAMGDLFLANSTFNSISDFVDYYLGKKWAFFVNWTYWLCWLGAGLAELTAIGLYIHFWFVHVPALISGGSALMILMAVNLVAVKWFGELESFFSIIKILGIFLFILLGIGLSVSDFHTQSIGIKENFGQIDELLPFGFAGMVVSFPMVLFSFAGIEMIGLTVGETSDPQKNLKKAINCLPWRILFFYIGTILSILFVVPWHCLDLKESPLVTMLQVIHCQGGAAIVNLMILVASLSSANSAVYSTSRILYQTAKEKSLPHWFCALSKKGVPLHGILITGMLFFAGLCLHFFVADSRLFFQLLAGMTTSCFLFVWSSILCAHVQFIKEKKRNTTQRYKDLALLVFFTSIAFSLLFESTTRFIPFLLVIWFVFLNFVYKRISNRNIS

SEQ ID NO: 11719 - protein, 549 aa, Hordeum vulgare subsp. vulgare
MAAAATRRAASSLVSRCLLSRPAASPAAVPSALRRADGARGLLPGLLQRFGTAAAAEEPISPSVQVGETQLLINGKFVDAASGKTFPTLDPRTGEVIARVSEGDAEDVDRAVVAARKAFDEGPWPKMTAYERSRILLRFADLIEKHNDEIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIISGFGPTAGAALAGHMDVDKIAFTGSTDTGKVILELSARSNLKAVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDDMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 11720 - protein, 195 aa, Triticum aestivum
  unsure (1)..(195): unsure at all Xaa locations
TRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHXLASRPGELIQPPXIFVIEGLXPMYDERVKELFXFXIYLXIXNEXKFAWKIXEHGEXGHSLESIXASQKP

SEQ ID NO: 11721 - protein, 309 aa, Ginkgo biloba
  unsure (1)..(309): unsure at all Xaa locations
MASDGVVTVYGDGAITDTKVSSYAVKVGLAQMLRGGVIMDVVNAEQARIAEEAGATAVMALERVPADIRAQGGVARMSDPGLIKEIKSAVTIPVMAKARIGHFVEAQILEAIGIDYIDESEVLTPADDXHHINKHNFRIPFVCGCRNLGEALRRIAEGAAMIRTKGEAGTGNVIEAVRHVRSVLGDIRKLQSLDDDEVFAFAKQIAAPYELVRQTKQLGRLPVVNFAAGGVATPADAALMMQLGCDGVFVGSGVFKSGDPARRARAIVQAVTHYNDPHILAEVSCSLGEAMVGINLKDEKVERYAERSE

SEQ ID NO: 11722 - protein, 171 aa, Aquifex aeolicus VF5
MLGSLIVNFKLFSAGGAIMEVFSRSFKNGEEIPKVYTCDGKDISPHIGWEDVPEGTKSFVLIMDDPDAPIGTFTHWVVYDIPSQTRELLEDFPKVPEVSGIKQGINDFGRVGYGGPCPPRGHGYHRYFFKVFALSVESLGLPPGASRKDVELKMNGKILAQAHIIGLYKRD

SEQ ID NO: 11723 - protein, 560 aa, Streptococcus agalactiae 2603V/R
MTESHNQYGADLIVDSLINHDVKYVFGIPGAKIDRVFDTLEDKGPELIVARHEQNATFMAQAVGRITGEPGVVIATSGPGISNLATGLVTATDEGDAVLAIGGQVKRGDLLKRAHQSMNNVAMLEPITKYSAEVHDPNTLSETVANAYRLAKSGKPGASFISIPQDVTDSPVSVKAIKPLSAPKLGSASVLDINYLAQAINNAVLPVLLLGNGASSEGVTAAVRRLLDAVKLPVVETFQGAGIVSRELEDETFFGRVGLFRNQPGDMLLKRADLVIAIGYDPIEYEARNWNAEISARIIVIDVEQAEIDTYFQPERELIGDMAHTLDLLLPAIKGYELPEGSKEYLKGLRNNIENVSDVKFDRDSAHGLVHPLDLIDVLQENTTDDMTVTVDVGSHYIWMARYFKSYEARHLLFSNGMQTLGVALPWAISAALLRPNTKVISVSGDGGFLFSAQELETAVRLHLPIVHIIWNDGKYNMVEFQEEMKYGRSSGVDFGPVDFVKYAESFGAKGYRVDSKDSFEETLKQALIDAENGPVLIDVPIDYKDNVTLGETILPDEFY

SEQ ID NO: 11724 - protein, 362 aa, Zea mays
MAFTEESSQDLLQAHDELWHQSVSYLKSLALTVALDLRIPDAIHHHGGGATLLQILDKTALHQSKLRALRRLMRVLTVSGTFSVVQQPPCGDDDSTVYRLTAASRFLVSEEVSSATLAPFMSVVLHPISQSSHARGICAWFRQEHHDPSAFGLAFGQAPTIWEHADDTNAILNKGLAAQSRFLVPVMLRECGEAVFRGIDSLVDVGGGHGGAATAIAAAFPHLKCSVLDLPHVVAGAPSDGNVQFVAGDMFQSIPPATAVFLKTALHDWGDDECVKILKNCRQAISPCDEGGKVIIMDMVVGYDESNTKRLEVQILFDLFIMMVNGAERDEQEWKKIFIQAGFKDYKILPVVGSLSVIEVYP

SEQ ID NO: 11725 - protein, 90 aa, Zea mays
TNGDYLLPFKTGAFLAGAPVQPVILKYPYRRFSPAWDSMDGARHVLLLLCQFINHMEVVRLPVYYPSQLEKEDPKLYANNVRKLIAMEVG

SEQ ID NO: 11726 - protein, 354 aa, Arabidopsis thaliana
MSAESCFGSSGDQSSSKGVATHGGSYVQYNVYGNLFEVSRNAATNSETGEEVAIKKIGNAFDNIIDAKRTLREIKLLKHMDHENVIAVKDIIKPPQRENFNDVYIVYELMDTDLHQIIRSNQPLTDDHCRLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 11727 - protein, 172 aa, Prochlorococcus marinus subsp. marinus str. CCMP1375
MIGSKLKEAIRSYSDFPKKGILFHDISPIFCKPDLYQELIEEMAKSEILNSSDAIISIDARGFLFGSCISLKLSKPLILARKAGKLPGPILSSTYNLEYGENSLSIQKESLNEFKNFAIIDDVLATGGTINCVKSLLTSHNKNISGACVVIELLALKAREKLDFPIYSTLTL

SEQ ID NO: 11728 - protein, 216 aa, Chlamydomonas reinhardtii
MSHKPDDDYDYLFKVVLIGDSGVGKSNLLSRFTRNEFSLESKSTIGVEFATRSIQVDGKTIKAQIWDTAGQERYRAITSAYYRGAVGALLVYDITKSVTFENVERWLKELRDHADSNIVIMLVGNKSDLKHLRDVQTEVAQAFCEREGLSFIETSALESTNVEKAFQQILTEIYHIVSKKVLDSEDNRPKIGEGRDVIVIDNAHDDGGKKKGGCCS

SEQ ID NO: 11729 - protein, 449 aa, Spermothamnion repens
ILALFRVSPHPGVDPVEASAAVAGESSTATWTVVWTDLLTACDLYRAKAYKVEAVPNTSDQYFAYISYDIDLFEEGSIANLTASIIGNVFGFKAVKALRLEDMRIPVAYLKTFQGPATGLIVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIVMIDLVIGYTAIQTMAIWAGKNDMILHLHRAGNSTYSRQKIHGMNFRVICKWMRMAGVDHIHAGTVVGKLEGDPLMIKGFYDTLLLSHLDINLPQGIFFQQDWASLRKVTPVASGGIHCGQMHQLLDYLGIDVVLQFGGGTIGHPDGIQAGATANRVALEAMVIARNENRDYVGEGPQILRDAAKTCGPLQTALDLWKDITFNYTSTDTADFVETPTANV

SEQ ID NO: 11730 - protein, 471 aa, Actinobacillus pleuropneumoniae serovar 1 str. 4074
MSVKRVFDLIKDNDIKFVMLKFTDIKGKEHGVSLPVSLIGDDLEDLFEEGKMFDGSSVEGWKAINKADMLLMPIAETAVVDPFARIPTLTLRCSIYDPNTMQSYDRDPRSIAIRAENYLKSTGIADSVMFGPEPEFFLFDDVRYNIGMNNVSYKIDDIEAAWNTNRKYEDGNTGYRPLKKGGYCAVAPIDSAHDIRSEMCLILEEMGLVVEAHHHEVATAGQNEIATKFNSLTLKADETQIYKYVVQNVALEHGKTACFMPKPFAGDNGSGMHCNMSLSKDGKNVFMGDKYAGLSETALYYIGGIIKHAKALNAFTNPSTNSYKRLVPGFEAPVLLAYSASNRSASIRIPAVTSPKATRVEARFPDPLANPYLCFAALLMAGLDGVVNKIHPGDAMDKNLYDLPPEELKEIPAVATSLEEALDSLAADYEFLTQGGVFTKEFVEAYINIRRKEVERLNMTPHPVEFEMYYA

SEQ ID NO: 11731 - protein, 237 aa, Streptococcus bovis
MWKKVSCLIVLLLAFFGFQQGVDAQSKYHYSQELNYYNGNAMELRNGSNGGMFNCNFVPGNVGFNNGLMSLKIDSDGRGGYTGGEWRSKERFGYGLFQVNMKPIKNPGVVSSFFTYTGPSDGTKWDEIDIEFLGKDTTKVQFNYYTSGQGNHEYLYNLGFDASQGFHTYGFDWQADHITWYVDGRAVYTAYNNIPSTPGKIMMNAWPGTHEVDSWLGAYNGRTPLYAYYDWISYDQF

SEQ ID NO: 11732 - protein, 352 aa, Azospirillum brasilense
MLTFTQREPIGVVGAIIPWNVPLYLMALKIAPALVAGNAVIVKSAEEAPLAALRVIQVMNQVLPAGVLNILSGDGPGCGAPLVTHPGVGKVTFTGSVETGKIISHLAADKLIPVTLELGGKSPMIVMGDADLDKAIDGAVAGMRFTRQGQSCTASSRIFVHESLHDAFIDKLKAKVDAMTMGDPLDEATDIGTIISPQQFERVQSYIALGEATAGAVAHRCSALPTDERLARGLFVQPVLFTGLANDHRLAREEIFGPVTCVIAFRDYEDALAMANDSDFGLAATIWTRDLRTALDATRRLQAGFVQVNQNLVVQPGLSYGGFKQSGLGKEASLEAMLDHFTHKKTVIINMD

SEQ ID NO: 11733 - protein, 330 aa, Helicobacter pylori 26695
MAQNLPTIALLATGGTIAGSGASASLGSYKSGELGIKELLKAIPSLNRLARIQGEQISNIGSQDMNEEVWFKLAKRAQELLDDSRIQGVVITHGTDTLEESAYFLNLVLRSTKPVVLVGAMRNAASLSADGALNLYNAVSVALNEKSANKGVLVVMDDNIFSAREVIKTHTTHTSTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVNSGEITSGEIDDKAFITSDNLNPQKARVLLQLALTKTNNKEKIQEMFEEY

SEQ ID NO: 11734 - protein, 196 aa, Mitthyridium sp. Wall 3784
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFTTDSHSSIFDAKAGIALSDTFVNS

SEQ ID NO: 11735 - protein, 377 aa, Oryza sativa
MDAAGMIIGGGGRRRLTRVRTLGRGASGAVVSLFAAGDDELLAVKSAAGPAGAAQLRREAGILASLCSPHVLPCFGFGAVAGGEYGLLLEFAPGGSLADEVARNGGRLEEDDVRAYAADVASGLAYLHGVGMVHGDVKGRNVVIGANGRAKLADFGCARRADSAGPIGGTPAFMAPEVARGEEQGPAADVWALGCTVIEMATGRAPWSGVDDVVAAVRLIGFTDAVPEPPEWLSPEANDFLDKCLRRRAGERWTAAQLLEHPFLALAGCRAVAAEETKPKWVSPKSTLDAAFWESDADDEDDDMPESWAERIMALAVPCSAVPDWESDDGWIDVMSSQSELPIAAAETPAEQTRSEVSESPVASPALETTSYASGLG

SEQ ID NO: 11736 - protein, 372 aa, Zea mays
MSGGVEPETPPGSSSRSGGSRSVGGKPPRHHLTSIRHCASIARIAAASAGFGLDSGTLSLISPTADIHPGFLPVFRSGSFADIGPKTYMEDEHVCVDNLVEHLGFYGPGIPAPGAFYGVFDGHGGTDAACFVRKNILKFITEDCHFPNSIEKAIRSAFVKADNAIADSHSLDRNSGTTALTVLIFGRTLLVANAGDCRAVLGKRGRAVELSRDHKPSCIVERLRIENLGGTVFDGYLNGQLAVARAIGDWHMKGSKGSVCPLTPEPEFREVRLTEEDEFLIIGCDGLWDVMSSQFAVSMVRKELMEHNDPQRCSRELVHEALRRDCCDNLTVVVVCFSADPPPQIEIPRFRVRRSISMEGLHRLRGALDSNI

SEQ ID NO: 11737 - protein, 348 aa, Kluyveromyces marxianus
MAIPETQKGVIFYEHGGELQYKDIPVPKPKPNELLINVKYSGVCHTDLHAWQGDWPLDTKLPLVGGHEGAGIVVAMGENVTGWEIGDYAGIKWLNGSCMSCEECELSNEPNCPKADLSGYTHDGSFQQYATADAVQAARIPKNVDLAEVAPILCAGVTVYKALKSAHIKAGDWVAISGACGGLGSLAIQYAKAMGYRVLGIDAGDEKAKLFKELGGEYFIDFTKTKDMVAEVIEATNGVAHAVINVSVSEAAISTSVLYTRSNGTVVLVGLPRDAQCKSDVFNQVVKSISIVGSYVGNRADTREALDFFSRGLVKAPIKILGLSELASVYDKMVKGQIVGRIVVDTSK

SEQ ID NO: 11738 - protein, 156 aa, Yersinia pestis KIM
MLLLDVVFVDFIPCQRTAKMAKELNPTENIEKLSDIQRYVTQERGTEAPFTGKLLHNKRDGVYQCLCCHQPLFISESKFDSGCGWPSFYQPIDADSIRYIDDYSHNMHRIEIRCGNCDAHLGHVFPDGPQPTGERYCINSASLNFVDDQNGEQTAG

SEQ ID NO: 11739 - protein, 195 aa, Cyanidium caldarium
MILIIDNYDSFSYNLVQSVGEINSDLIVLRSDEIDVSKLQNLNIKHIIISPGPGHPDEYTICKQVVKFFAPYTPILGICLGHQIIATCYNASIKKSSPVFHGRASKIYCLKDKLFLGIHAPFTAARYHSLVVDQDKRGLDLTTCLKTIAITREGVIMACKHRYYHFTYGIQFHPESMLTIQGTKLLKNFLSLSYG

SEQ ID NO: 11740 - protein, 346 aa, Staphylococcus aureus subsp. aureus N315
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNWRALFINVSFINCITYSSLVKLHFP

SEQ ID NO: 11741 - protein, 86 aa, Buchnera aphidicola
LYEPAGGSAPDISGKNIANPIAQILSISMLVRYTMGLNKIADDIESAVNNALKKGYRTLDIANKNENYVSTSHMGDIISNILNKRV

SEQ ID NO: 11742 - protein, 263 aa, Gossypioides kirkii
AWTKEEDQRLIDYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNTPTSVSKSSSIKNPNFNYNEFQFKSNTDSLEEPNCTASSGMTTDEEQQEQLHKKQQHDPCNGQDLNLELSIGIVSADSSRVSSANSAESKPKLDNNNFQFLEQAMVAKAVCLCWQLGFRTSEICRNCQNS

SEQ ID NO: 11743 - protein, 525 aa, Cucumis melo
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 11744 - protein, 481 aa, Oryza sativa
MAMRKRMRGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAVKPVKGDTVLFFSLHIDGVPDPLSLHGSCPVIEGEKWSAPKWIRIRSYEHPPVSKVTEGCSDNSARCAKWAEAGECEKNPVYMTVNSSILFLQKQRLTSFAHGFEISSLLLVEVKTVKFARSARRVSATTLAILFGGLILVSLLVETSAKPPSPGSSVLGVGGRRMMINGGLVHSHRSLEDFNAGDAFSSMKRRVPNGPDPIHNRLSIPSFIYSGFLMVFTLNSSEELENQEDHQAERRKAHCKFAIEEKECSFEQPKLHPECGLKAKLV

SEQ ID NO: 11745 - protein, 474 aa, Haraldiophyllum ramirezii
RYESGVIPYAKMGYWDPDYVIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNITAATQEDMYERAEFAKQLGSVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDINLPQGIFFTQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITFNYTSTDTADFVETPTANV

SEQ ID NO: 11746 - protein, 125 aa, Desulfitobacterium hafniense
MPNDHQQLHRGLSERHIRLMALGAAIGVGLFLGSANAIKLAGPGILLAYLLGGGAIFIIMRALGEMAVHNPVAGSFSRYARDYLGPLSGYLTGWNYWFLWLVTCVAEITAVGVYMQVWFPARRMG

SEQ ID NO: 11747 - protein, 475 aa, Vicia faba var. minor
MTMEEKEEHSTEAAVTSHNDSKLFDDDDRVKRTGTVWTTSSHIITAVVGSGVLSLAWAIAQLGWIIGLSVMIFFSLITWYTSSLLSECYRTGDPHFGKRNYTFMEAVHTILGGFYDTLCGIVQYSNLYGTAVGYTIGASISMMAIKRSNCFHSSGGKDGCRISSNPYMISFGVIQIFFSQIPDFHEMWWLSIVAAIMSFTYSLIGLGLAIAKVAENGSFKGSITGVSIGTVTEAQKVWGVFQSLGNIAFAYSYSQILIEIQDTIKSPPSEMKTMKQATKISIGVTTIFYMLCGGMGYAAFGDLSPGNLLTGFGFYNPYWLIDIANAALIIHLVGAYQVYAQPLFAFVEKIMIKRWPKIKKEYKLTIPGFRPYHLNLFRLIWRTIFVITTTFISMLIPFFNDVLGLIGAAGFWPLTVYFPVEMYIKQKKITKWSYKWISMQTLSVICFVVSVVAFVGSVSSIVVDLKKYKPFTTDY

SEQ ID NO: 11748 - protein, 262 aa, Oryza sativa (japonica cultivar-group)
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKFLKSFTNRTKAVVLNSPHNPTGKVFSREELLIIAQACQKMDCFAITDEVYEYITYDENKHISLASLPGMQERTIITSSLSKTYSVTGEQNSSLHTAMQSTTCETFGTYEDSVV

SEQ ID NO: 11749 - protein, 449 aa, Oryza sativa
MQLFQGEEPAHDFLSLRAGGGSSSPPFQHREEQHSSHSSRGYGMEIRRSLRPLDLAKQRGRSSGNGTAAGSAVDGASPAGSDSEEHVLPGGVGTFSIRHASGTPSREEAGSHGGVRRSAFAFAPALHGARMENAHETGGRSGSRAHRAPSTMWQDSAIDQRSIGQTPYEAFNSKTISYKYMVQEMCSKMQFFMLSFRLEILRELLPHTDQKRDKASFLSEVIEYIRFLQEKVQKYEEADPERNHEDSKSMPWAKVYYRSCWRNTKNTSQVQGEDLSPSTQDMNNEQYGPKHISAAQPALFNTQSVTSTTTSSSHMATGTPQNLEKNSTPSNQPPWLSMSTMRQESEPGNKMPNKHEKQTLHDENHSISSAYSQGLFNRLTEALKKSGLDPSQANIAVEINLAKRARDNTSDNSKIVCLIIILYLCPDFTSQINEDEEPIQITKRRCNKS

SEQ ID NO: 11750 - protein, 384 aa, Listeria innocua
MEKIYLAIALVLGVSQIFGVLASRMGLPKIVGELLVGVVLGPSLLNIVQPGEFLHIFSEIGVLLLMFIAGMETDFKKLKANLKPSIIVALFGVIIPLVAFLLFGKYLHMETMESFFVGIIFSATSVSITVKIFMDSDILQTKVAAIVLGAAVIDDILAVLLISAYKSVDQLATANIFFMLWDLLLSKILFFIMLYLFYKFALPWIKRYTEKWTWSFLPVTITLIICFFWGYFAELMGLSAVLGSFFFGLMLAISGTKQRVEKEIDLIANSIFIPLFLTSIGAAITLSDIWGNVGPIALGTLLAIITKLGSCYIAARASKLSRPDSFLIGSGMMSRGEMALVTLNIGISLHFIGEDYYSIFVAIIVMTTILSPLFIKLALPKSSH

SEQ ID NO: 11751 - protein, 109 aa, Oryza sativa
QGNIPKGCMAVRVVGPGGVGGGGGGAEGERFVVPVGYLKHPLFVGLLKEAEEEFGFEQKGAITIPCGVDHFRRVQGIIHHQKHHHGGSHSGHGSSGHHNNFHIAACFRA

SEQ ID NO: 11752 - protein, 519 aa, Candida maltosa
MIFTAFILDYWYFTLLFLIAAYFIGKHVYTNYLMRKHHAEPILDVVDDGAFGFKFGFQSLKAKKIGNQIDLLFLKFNEAKHPSIGTFVTRSFGMQFIATKDPENIKAMLATQFNEYTLGQRLNFLAPLLGKGIFTLDGNGWKHSRAMLRPQFSRDQIGHVKMLEPHFQLLKKHIIKNKGTFFDIQELFFRFTVDSATEFLFGESVSSLKDESIGYDQEEIDFAGRKDFAEAFNKSQVYLSTRTLLQLLYWLVNSADFKRCNKIVHKFSDYYIKKALTATPEELEKHSSYIFLYELAKQTRDPIVLRDQSLNILLAGRDTTAGLLSFAVFELGRNPEVWSKLRQEIGHKFGLDSYSRVEDISFELLKLCEYLKAVLNETLRLYPSVPRNARFAAKNTTLPHGGGPDGMSPILVRKGQTVMYSVYALQRDEKYYGKDANEFRPERWFEPEVRKLGWAFLPFNGGPRICLGQQFALTEASYVLARLIQSFETLELSPEAAYPPAKLSHLTMCLFDGTPVRFE

SEQ ID NO: 11753 - protein, 637 aa, Brassica napus
MASFSFFGTIPSSPTKASVFSLPVSVTTLPSFPRRRATRVSVSANSKKDQDRTASRRENPSTFSSKYAPNVPRSGADILVEALERQGVDVVFAYPGGASMEIHQALTRSNTIRNVLPRHEQGGIFAAEGYARSSGKPGICIATSGPGAMNLVSGLADALFDSVPLIAITGQVPRRMIGTMAFQETPVVEVTRTITKHNYLVMEVDDIPRIVREAFFLATSVRPGPVLIDVPKDVQQQFAIPNWEQPMRLPLYMSTMPKPPKVSHLEQILRLVSESKRPVLYVGGGCLNSSEELRRFVELTGIPVASTFMGLGSYPCDDEEFSLQMLGMHGTVYANYAVEYSDLLLAFGVRFDDRVTGKLEAFASRAKIVHIDIDSTEIGKNKTPHVSVCCDVQLALQGMNEVLENRRDVLDFGEWRCELNEQRLKFPLRYKTFGEEIPPQYAIQLLDELTDGKAIITTGVGQHQMWAAQFYRFKKPRQWLSSGGLGAMGFGLPAAMGAAIANPGAVVVDIDGDGSFIMNIQELATIRVENLPVKVLLINNQHLGMVLQWEDHFYAANRADSFLGDPANPEAVFPDMLLFAASCGIPAARVTRREDLREAIQTMLDTPGPFLLDVVCPHQDHVLPLIPSGGTFKDIIV

SEQ ID NO: 11754 - protein, 592 aa, Fusobacterium nucleatum subsp. vincentii ATCC 49256
MKKRIADLIFETLVKYNIKTCFAVVGGGAMHLDNALGLNKDIEKIFNHHEQACTIAAEGYAKITGQMAAACVTSGPGATNAITGVMGAWVDSVPMIVLSGQVRYSLTVKATGLPLRFRGVQEFDIINSVKNMTKYAVMLKEADKVIYELEKAIYIAMNGRRGPVWLDIPLDIQGAEIEEADLQHFIPNEPLISCSEENFVELEKMIKKAERPIILAGNGIANSGALKKFHDFAKHLGIPVIAATIAADAMYHDYELYYGLSGSIGPRVGNFILQNSDFILALGTSLGFRTTGYSQDAFAPKAKIVMVDIDDYEKQKPGVRYNLFIKADLHSFLIEGLKKLSKKNLDISWKKYCDALKSKFTPYETVVGIKEDERVGMYYFWKKFSELEPEDTIIALGNNTGICSKLQIGVKTDKQRVLANNNCGSMGYDIPCALGAAVATKKEVILVTGDGSFMMNLQELQTIAHNKLPVKIVVFENNGYNAIRQTSKNFFNGFEVGCSKESGISFPSFKEIAKTFGFKYNVANTNKDLEETLKWLFNEKGNVLLEIKEKLDDPITPRLMSRMGADGKFLSPALEDLYPFLDEEELKKWMWK

SEQ ID NO: 11755 - protein, 204 aa, Glycine max
  unsure (1)..(204): unsure at all Xaa locations
ERERERERERETERERERERERERKTKREAAAKKAAEDAANLEKGDEHQASSQHATVTERAAAATSEADNKTSDFMDDDSALLQQALAMPMDDSAISHDVKDTHMSEASAIDPDLALALXLSITDSAKDXSSQXDXEQIVXPDQSFGXXILXSLXGVDPXDLXXXDFLXSCDSLATISFSFLSPFPFFSFFYGLAMCGFLRCFA

SEQ ID NO: 11756 - protein, 324 aa, Bacillus cereus ATCC 14579
MKRILVLHTGGTIAMEEDKETGVVQPGEENPLLKFIPDLEADVDLIVEDVFHLPSPHMTPSEMLQLQVIIDERVKQDNIHGVVITHGTDTLEETAYFLDLTVQATIPIVVTGAMRSSNELGADGLYNFLSAVKVASCDEAAEKGVLVVLNDEIHCATNVTKTHTSNVATFQSPQYGPIGMVTKRGVVFHHALVHHETYTINKVSKNVVVLKAYAGMDDTLLAAIENLPVDGIVIEALGQGNLPPRTLPSLERLLNRGIPVVLVSRCFNGIVQDVYSYEGGGKHLKDMGIVFTYGLNAQKARIKLLVALENTNSHESIQNMFMHE

SEQ ID NO: 11757 - protein, 333 aa, Cytophaga hutchinsonii
MKVAINGFGRIGRISYRALLKKKNIEVVAINDLTDTKTLAHLFKFDSSHGVFDGEVSYDAENLIINGKKVKVLSVKNPADLPWKALGVDVVLESTGFFTEKEKAEAHITAGAKKVIISAPATGDLKTIVLGVNDNILDGSETVISNASCTTNCLAPMVKVLEDNFGIESGFMNTIHAYTSDQRLQDAPHKDLRRARSAALSIIPTSTGAAKALGLVIPSVQGKLNGTSLRVPVPVGSITDFTATLKRTVTKDEINAAFKKAAEEGSLKGYLAYSEDPLVSVDIVGNPASSIFDSELTMVQGNNVKVFGWYDNEFGYSNRTADLIELVGKQIKA

SEQ ID NO: 11758 - protein, 452 aa, Gelidium crinale
ETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYASTDTADFVETPTANV

SEQ ID NO: 11759 - protein, 500 aa, Amaranthus hypochondriacus
MAIRVPSRQLFIDGEWREPIKKNRIPIINPSTEEIIGVIPAATAEDVELAVAAARRALKRNKGEDWASASGAHRAKYLRAIAAKITEKKDYFAKLEAMDCGKPLDEAAWDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCVKTFGSEDEAIELANDTQYGLGAAVLSKDLDRCERITKALQAGIVWVNCSQPCFCQAPWGGTKRSGFGRELGEWGIENYLNIKQVTEYISDEPWGWYKSP

SEQ ID NO: 11760 - protein, 270 aa, Zea mays
MPEILRPSTQSAGSNPPSALDPRTSEIRPSPLRGQEMLLLLFFSVLAAVAAFLLFKFATVVDGDLTLVSRGPPLRERVDGKVVWITGASRGIGEVLAMHFANLGAKLILSARNKDALARVKKNILTGEESLKEVVHVAESFFSNAGVDYMVHNAAFERPKRRALEESEEGLKATLNVNVFGTITLTRLLAPYMLDRGMGHFVVMSSAAGKVPAPGQAIYSASKHALNGYFASLRSELCTKGIKVTVICPGPIETLQSSAAASSSQTHSAE

SEQ ID NO: 11761 - protein, 321 aa, Bacteroides thetaiotaomicron VPI-5482
MDKKVTLAQLKEVVQEAYDQVKTNTGGKNADYIPYLANVNKDLFGISVCLLNGQTIHVGDTDYRFGIESVSKVHTAILALRQYGAKEILDKIGADATGLPFNSIIAILLENDHPSTPLVNAGAISACSMVQPIGDSAKKWDAIVENVTDLCGSAPQLIDELYKSESDTNFNNRSIAWLLKNYNRIYDDPDMALDLYTRQCSLGVTALQLSVAAGTIANGGVNPVTKKEVFDASLAPKITAMIAAVGFYEHTGDWMYTSGIPAKTGVGGGVMGVLPGQFGIAAFAPPLDGAGNSVKAQLAIQYVMNKLGLNVFSDNHLIVVD

SEQ ID NO: 11762 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 11763 - protein, 353 aa, Emericella nidulans
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTVFMQPAQIEGDSLPSEVGNAIAALWQDAGVQECFKRSREYQLNDSAKYYFDSIERIAQSDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 11764 - protein, 261 aa, Vicia faba
AHIITAVIGSGVLSLAWAIAQLGWIAGPSMMLLFSFVTYYTSTLLSACYRTGDQLNGKRNYTYTDAVRAYLGGFKVKICGLVQYVNLFGVAIGYTIAASISMMAIKRSNCFHSSGGKDPCHMNGNLYMISFGIVEIFFSQIPDFDQLWWLSTLAAVMSFTYSTIGLGLGVGKVIENKGIKGSLTGITVGTVTQTQKVGRSFQALGNIAFAYSYSMILIEIQDTIKSPPSESKTMKAATLISVVVTTIFYMLCGCLGYAAFG

SEQ ID NO: 11765 - protein, 393 aa, Ralstonia metallidurans
MASSPTTITTSRPTALPNSPRRMSMTFQMNAGAVRRFAKAMRFGAWLQSITERMTPAPFRLVQIGSAYWQSKALYVAAKLDLATVLGTATLTASALASRVGANEDALGRLMRLLAAMGIFEETAPMVFRNNKLSRCLVSDDPQSVRAMILMHNSETMSRPWFEQLEAGIRSGTPPFQLSHGEDLFDYLDHHADFDQLFSEAMNSVEALAGDGFATDLDWARFDRIIDVGGSRGTKSLAILRRHPRLTALIVDRPQVIEEAQRYWAEHHADGLERLQFQAADLFESLPAAGPKDVYLYSAVLHGFDDPTCVQALLRLREAIGNSGARAAILEIVVPEKGADISSASFDMQMFVGSRGRERTLTEWKAIIQAGGLTLEEVVRLRSLGSILVLRAG

SEQ ID NO: 11766 - protein, 99 aa, Zea mays; identical to SEQ ID NO: 3237

SEQ ID NO: 11767 - protein, 332 aa, Methylocystis sp. SC2
MQNFSSYLIGLIAVALIFDFLNGLHDAANSIATIVSTRVLRPQFAVAWAAFFNFIAFVFFGLHVAQTVGAGIVSPNIVDDFVVFGALMGAIVWNLITWGLGIPSSSSHALVGGLVGAGVAKVGASAIVWDGLLKTSVAIVLSPALGFVLALALILLVSWIFVRRTPGGVDALFRVLQFASASLYSLGHGGNDAQKTMGVIAVLLYSHGALGGEFYVPFWVVIACQAAMGLGTLFGGWRIVRTMGSRITRLTPVQGFCAETGGAITLFLATALGVPVSTTHTITGAIIGVGASRRVAAVRWNVAKDIVVAWVITMPMAAFFAATFYALARFAA

SEQ ID NO: 11768 - protein, 325 aa, Eremothecium gossypii
MHGVKRRLWTQEALKQKRAQDKQRIKAYRDQTARVLRLRDAGAYSMEALAETTSLLQMNGEFNAVWNYRRDIIAALREQLDGGFWEAELKLTMAHLRESPKVYWIWNHRQWCLQHHAEQGAAVWKRELALVGKMLELDPRNFHGWHYRRVVVRELERRSGASLDSAELSFTTEKINENISNFSAWYQRAQLIPRMIASGKIADTSRFAEEEASYIINAMYTDAEDQSVWMYLKWFAEASCIRDDMPLQDYDCMLTKFRENIMAINQDELEFSGRENIWCLKMLVFLGSIAPTQQESPAQRRHHLERLIELDSMRRNRYIHMLENA

SEQ ID NO: 11769 - protein, 221 aa, Glycine max
  unsure (1)..(221): unsure at all Xaa locations
MSEVFEGYERQYCEQSANLSRQCTAASALDGEQKKQKLSDKSXGLDDADTLIRKMDLEARSLQPSVKAALLAKLREYKTDLSNLKSEVKRVTSASVNLTARDDLLESGRADTLAASNDQKGRLLMSTERLNQSSDRIKESRKTMLETEDLGEFILRDLHQQRESLLHAHKTIHGVDDNISKSKKILSAMSRRMSRNKWIVSSLMTALVLAILIILYFKLTH

SEQ ID NO: 11770 - protein, 781 aa, Oryza sativa (japonica cultivar-group)
MDAETGPAAPQDQWKSYCRTISLLAFQSFGVVYGDLSTSPLYVYKSAFSGRLNNYRDETTIFGLFSLIFWTLTLLPLLKYVIIVLNADDNGEGGTFALYSLLCRHAKFSLLPNQQSADEELSTYYQPGVGGIISSPLKRFLEKHRKLRTCLLLFVLFGACMVIGDGVFTPAISVLSAISGLKDPGPGGIPDGWVVFIACIVLVGLFALQHRGTHRVAFMFAPIVVVWLLSIGVIGLYNIIHWNHRIFLALSPHYVIKFFKMTGKDGWLSLGGVLLAITGTEAMFADLGHFTAASIRLAFVGAIYPCLVLQYMGQAAFLSRNMSAVEDSFYQSVPRSLFWPVFVIATLAAVVGSQSIISATFSIVKQCLSLGCFPRVKVVHTSRWIHGQIYIPEINWILMVLCLAVTLGFRDTTVIGNAYGLACIVVMFVTTWLMALVIIFVWQKNILLALLFVVAFGSIEVVYLSAAVTKVPQGGWAPIVFAFVFMLVMYVWHYGSRRKYLFDLQNKVSMKWILTLGPSLGIVRVPGIGLIYTELVTGVPSIFSHFVTNLPAFHQVLVFVCVKSVPVPFVPEDERYLIGRIGPREYRMYRCIVRYGYKDVQKDDENFENHLVMSIAKFIQMEAEEAASSGSYESSEGRMAVIHTEDTTGTGLVMRDSNNEASGTSLTRSSRSETLRSLQSIYEQESGSLSRRRRVRFEIAEEERIDPQVRDELADLLDAKEAGVTYIIGHSYVKARKNSNFLKTFAIDYAYSFLRKNCRGPAVALHIPHISLVEVGMIYYV

SEQ ID NO: 11771 - protein, 267 aa, Zea mays
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGN

SEQ ID NO: 11772 - protein, 418 aa, Glycine max
  unsure (1)..(418): unsure at all Xaa locations
MSTTTVSGGDPPSRGFDTPTLDREAAALLHAISEHGGYAYVSMAVLASGGDIRAAEAAREMXWEQLHSGPWHSVLPVWRDAYSMACLLVARHHYRNGEFWDALRVLDLGIIMGGTLLRKDLDSAIEKISEQTRKSVRVSDLGNSEHRLVDREFDMAEELRTPTRRSRIXKCISNKLVAKKSALSLEKFLKDHYLSGCPVIISDCMAHWPAKMKWNDEDYLLRVAGDRTVPVEVGKNYLCTEWKQELITFSEFLQRIKSDSCSPGGLTYLAQHPLFDQINELRKDIFIPDYCFTGGEQLRSLNAWFRSVGTLTPLHHDPHHNILAQVVGKKYIRLYSSSLSEELSPHSGTMLHNSSQVDLDDIDENKFPKVQDLEFVDCILEEGEMLYIPPKWWHYVRSLTTSFSVSFWWSEGESSDAS

SEQ ID NO: 11773 - protein, 427 aa, Batrachospermum virgato-decaisneanum
IEAAAAVAGESSTATWTVVWTDLLTACDLYRAKAYKVDSVPNASDQYFAYIAYDIDLFEEGSIANLTASIIGNVFGFKAVKALRLEDMRIPVAYLKTFQGPATGTIVERERMDKFGRPFLGATVKPKLGLSGKNYGRVVYEGLKGGLDFLKDDENINSQPFMRWRERFLFSIEGVNRAQAATGEVKGHYLNVTAATMEDMYERAEFAKELGSVICMIDLVIGYTAIQTMAVWARKADMILHLHRAGNSTYSRQKIHGMNFRVICKWMRMAGVDHIHAGTVVGKLEGDPLMIKGFYNTLLLSHLDVNLPQGIFFEQDWASLRKVTPVASGGIHCGQMHQLLDYLGDDVVLQFGGGTIGHPDGIQAGATANRVALESMVLARNEGRDYVNEGPQILREAAKTCGPLQTALDLWKDISFNYTSTDTADFV

SEQ ID NO: 11774 - protein, 338 aa, Bradyrhizobium japonicum USDA 110
MAGLLRRAAVVAAPAGLMSIVAAPAQAAGSEINTADTAWMIVATALVLMMTIPGLALFYSGMVRKKNVLATMAQSLAAVTMISILWVAFGYSLCFVGDGPWIGTLDRWFLAGMTLDSVNPAAKTIPESLFMLYQMTFAIITVALVAGSVADRMRFSAYLLFSVAWFIFVYIPLAHWVWGGGFLASMGVLDFAGGLVVHLSAGTAGPRRRQGDGAPPRLRHRKSLAVRSVARRDGHWPVVGRLVRLQRRFGRRGQFARGAGDHRDPSGGLLRRADLGRNRMVNAAQAFRARHDLRRGRWPRHHHAGFGLRRAVAWHRHRHHRRGGLLLGLHLAEAPLRL

SEQ ID NO: 11775 - protein, 159 aa, Caulobacter crescentus CB15
MTDAATLSTAGFDLTPPTEAERERLEANLTAEEARVLLHHGTEAPFCGGLLGEKSPGVYGCRLCGLPLFKHETKFESGTGWPSFYAPFAEDHVVGVRDTSYGMVRIETRCARCDSHQGHVFPDGPAPTRLRYCINSVSLQFVKAGAPLPDPLHRGDKIT

SEQ ID NO: 11776 - protein, 172 aa, Prochlorococcus marinus subsp. marinus str. CCMP1375
MSRSQSLDLPQVGRIDTLAQELALLQDKGKRRIAFLGSRHVPVVTIHLIELIARSLAQEGHSIITSGSQGVNAAVIRGVLEVEPSLLTVLLPQSLNRQPLEICNLLDQVLHLIEKPDNDDLSLPMASSLCNQEIISRCDQLICFAFHDSETLLSSCHSAEDMGKVVSLLFFD

SEQ ID NO: 11777 - protein, 488 aa, Pogotrichum filiforme
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHAIGSCIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 11778 - protein, 336 aa, Halobacterium sp. NRC-1
MHPDAVRDAGRVAHGGSDDPDVLDFSANTTPRTPPGTRAAYAAALDDAARYPDDDYPAFRAAAADHVDCARDTVVQTPGGLAGIRLAIETRVTPGDTVLVPAPSFSEYAREVELQGATPVFVPHDALLDADPSEHTLAIACTPNNPTGDRYDDDALRAFAARCRAANTELLVDEAFLGFTDAPSIAGTPGVVVARSLTKLFGLPGLRAGFLVAVGDRLTTLRTARRTWNLGAPAAAVGAHAMRQSEFVAETRRHVASERARMRAALSDAFDVHPSSAPFLLLDVGPRPVDAVMAAASAEGIRLRDATTFRGLDSHVRVAVRTPDENDRLLAALADV

SEQ ID NO: 11779 - protein, 223 aa, Triticum aestivum
FPGRPRVRAPQYIILVLGADDNGEGGTFALYSLMCRRSRMGLLNSLHAGHGSVSSYNQDEPCKETRSSLAIRGFFEKHHSLRVVLLLFVLMGTSMVIGDGVLTPTMSVLSAVSGLRIKFPELHENYTVLLACVVLVGLFALQHYGTRRVGFLFAPILLSWLACIGGIGIYNIFRWNPTVVRALSPYYIYNFFRKAGRDGWSSLGGIVLCITGAEAMFADLGHF

SEQ ID NO: 11780 - protein, 569 aa, GIBBERELLA ZEAE PH-1
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWAFVLPLELTVFLAVIIIVNIFGTLGYAEEEFWAALLKLSATVIFMIVAVVLVCGGGPSNGIYDEYWGARLWHNPGAFQHGFRGFCGVFVTAAFSFSGTELVGLAAAEAKNPAKALPGAIKQVFWRITLFYVVGLLLVGFLVSSTDERLLNAGNNNPSASPFVIAASNAGLKGYDSFMNVIILVSVLSIGVSCVYGGSRTLVALAQQGYAPKFFSFIDKSGRPLPAVVSIIAIGALGYISVDGEGTTVFIWLQALSGLAALFTWGSICLCHIRFRSAWKYHGHTLDEIPFQHVFGVWGSWLGLAIIVIVLIAQFYTAITNIDGSIGTAEGFFQSYLAMPVVILFYIIGYIWKREGWRKISEIDLDTGRREHDWDAINAYRQQLANGPAWKHGVQTFPVTGGLIIHVLPWTQMGPE

SEQ ID NO: 11781 - protein, 566 aa, Oryza sativa
MKVDGSALAGRALAAAGARHMFGVVGIPVTSLASRAAAAGVRFLAFRNEQSAGYAAAAYGFLTGSPGLLLTVSGPGCVHGLAGLSHATANAWPLLMVSGSCSQPDAGRGDFQELDQIAATKPFIKIAVKATTIADIPRLVFQALAATVSGRPGGCYLDIPSDVLHQTLTESEAAALIDAAAADSAKSDSSPPKHKSLDEGIEKAAELLRRAERPLVVFGKGAAYSRAEDAIWKLVDTTGIPFLPTPMGKGVVPDTHPLSATAARSLAIGQCDVALVVGARLNWLLHFGEPPKWSKDVKFILVDVCEEEIELRKPHVGIVGDAKRVVELINREIKDQPFCLAPSHPWVEAITKKARDNVLKMEAQLAKDVVPFNFLTPLRIIRDAILAEGNPAPVVVSEGANTMDVGRAVLVQNEPRTRLDAAAVAEPDRLVVAVEGDSGFGFSAMEVEMYMDKRVEDGPSCKTLVRYQLPVVVIVFNNNGVYGGDRRSPDEITGPYKDDPAPTSFVPAAGYHKMMEAFGGKGYLVETPDELKSALSESFRARKPAVINVIIDPYAGAESGRMQHKN

SEQ ID NO: 11782 - protein, 153 aa, Zea mays
  unsure (1)..(153): unsure at all Xaa locations
MSGAGEEDKKPAEGGAHINLKVKGQDGNEVFFRIKRSTQLKKLMNAYCDRQSVDMNAIAFLFDGRRLRGEQTPDEVTQFGFRSQHXSGIIDRYLXMAVQLEMEDGDEIDAMLHQTGAAFLAPPPPKSSSCGASFCSPPCVVLNKREKVFLRNL

SEQ ID NO: 11783 - protein, 91 aa, Zea mays
  unsure (1)..(91): unsure at all Xaa locations
DKDALITLVSSCLSGEAEQIXWSQIHTPTEDVLAPNDILSPPXPEDLMEYKNLMYKLDVLKLNEVVGTTMDCTGPKAVIVARKGYTFLDLI

SEQ ID NO: 11784 - protein, 135 aa, Phaseolus vulgaris
TSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 11785 - protein, 637 aa, Agrobacterium tumefaciens str. C58
MTSSNSTVPDSRSETKKFLVLLLGSIGVVYGDIGTSPLYAFRESLRPFTANGVQHEHVVGLISLMIWTLTIIVTFKYVLFLLRADNDGEGGTLSLLALLMKKTGSYMPVLFFAGLIGSALFIGDAMITPALSVMSALEGMKLVTPAFSDYVLPLSALIMVGLFAVQSKGTGAVAVFFGPITVVWFLAMAWGGLIHIGDDWTILEAVNPINALWFITHAGWAGLIVLGAVFLTVTGAEALYADLGHFGRKPISVAWFILVFPALALNYLGQGALVLSNPAAIENPFYLLYPEWALFPMIILATMATVIASQAVITGAFSLARQAVHLGFLPKLMIRFTSETNTGQIYVPAVNMVLFIGVLVLIFSFGDSESLATAYGISVTGAMVVTTLMAFQFLRSIRGKSAFTAAILLAPLFSIEAVFLAANLLKVHDGGWVPLALAGVIILVMWTWTKGSRYLREKISKNDVSLDTFITSLERSISRESRSAPVLVSGTAVFLTSVPDKAPSVLLHNLKHNHVLHEQNVILTIWTHDKPYVADTDRVEITRISKHFMRLDINFGFMDDPNVVKALPLCKKKGFKFEIMQTSFYLGRRNLIATPNTGLPRWQEDLYIALADFGVDPSAYFKLPPNRVIEIGEQVAI

SEQ ID NO: 11786 - protein, 480 aa, Oenococcus oeni MCW
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 11787 - protein, 762 aa, Debaryomyces occidentalis
MLGFSSLGAIYGDIGTSPLYVLNSIKYPNSSPTEEDIYGAISIIFYLFTFIVIFKYILIVLFLGTNDGEGGQVAIYAKIARSLKIGPKGVHIPGSPEKTDLELLARAETSSSFKSSNLFLNKASGFKTNPKLIKFISKFILFGCFFGCSLVMSDGLLTPTTSVLSAIAGIQIANPSFNDVLAVSEVVLIVLFLIQQFGSNKISFTFAPIIFLWLIGLIISGIYNIVKFHPAVFKSLSPYYAIQLLKHSGIDVFSGAMLSITGTEAMFADVGHFGRLPIQLTLTLFVYPALIICYLGQGAYIIKHPEALSNPFFYSIPGGLNSWIYWVMFVLATLSTIIASQALILGVFSITSQLINLDCFPNFKIIHVSKKYAGKVYIPAINWLLMIGVCATTAGFKNSNNVTAAYGLGITLDFLVTSSLIMVCMTYVYNWNILIPITYALIFLPLEVIMVISNLKKITHGAWFPLMMSGIFMMFLSFWRWARSRKVNQDFKTRIRIGDLYPELKKQPPQSETVDLNDRGRPMSIVNSSNEELVEYGVTLPKILKTNNNQLKVQSKFGLMNLKKYDGIAIMYNDSSVHTLNSPNTVPQVYGKLVSSFSSIPSVFIFCSIRVLSIPTVPNDERVLIGSMKIPGHYRCIIRYGFMEEILIDKELNNHILNSIPDINELAIKFNLNNKCILTKPCTIPILHIFENNLIRSHDYSSEEHETKNPLVKCKRFIRKILINHIFSPIYSDFQSNGKFLKISDEDEESEKKMFLGGVVRI

SEQ ID NO: 11788 - protein, 410 aa, ASPERGILLUS NIDULANS FGSC A4
MFITSAAAFVWANLNPTNYIGSVSFCPERDIPDLAGKVVLVTGETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPVGIVKQRNRYVVDQKMGRRLWEWTETELKRDHKEGFIERMLQPHPHHQRRRSSVGEGEIEKPDLAIGLERQSSTERNEQGQNQAESGGQNVLRPQRRNSRLQRLKEFMHSEEELDDAGKTYAKLM

SEQ ID NO: 11789 - protein, 422 aa, Spinacia oleracea
MGSSDDVKSPKSEKTSPPATEHNGVHMYPDWAAMQAYYGPRVALPPYFNSAVAPGHPPPPYMWGPPQPMVPPYGAPYAAIYAPGGVYAHPAIPLASQAHGQEVAPPAVSEPLVATPLSMDTPAKSPKNADKGFIKKLKGFNGLAMSIGNGNTEKTEGDVENRLSQSAESEGSSNGSDGNYTEDADDNKRKRSREGTPISVEAEKTEIKAVLPPPADKVLGIPVTSANAVAGQVMGTVVSPGVATTLELRNPGVTVKGNSSPVSSPNGVVSSEAWLQTQRELKRERRKQSNRESARRSRLRKQAETEELARRVESLSAENMALKSEVNLLVENSQKLRLENAALTGKLKNLQSGQGDENGLANVDTKRNPSDSTENLLSRVNNSSSVGRNSDEGAEMFGKSAKSGAKFHQLLDNRRGDAVAAR

SEQ ID NO: 11790 - protein, 328 aa, Oryza sativa
MVLPVLAPLAGATAVAFLLFKFATVDGDFTLVSRGAPRREKVDGKVVWITGASRGIGEVLAMQFASLGAKLILSARNKEELERVKHNIINKHPNSRVEVLPMDLSSGEESLKEHVHEAESLFSNAGVDYMIHNAAFERPKRRALEDTEHGLKATFDVNVFGTITLTRLLAPSMMDRGMGHFVVMSSAAGKVPSPGQALYSASKHALNGYFSSLRSELCTKGIKVTVVCPGPIEAPQSSGATSSSQKPSSEKRVPVERCAELTIVAATHGLKEAWISYQPVLGVMYLVQYMPTVGLWLMDKVGAKRLDVAAKKGNAYGWNLLFGGKKSA

SEQ ID NO: 11791 - protein, 257 aa, Zea mays
MDPGAGAHYSVRTAEEVFRDFRGRRAGMIKALTNDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGVANKQNKEKGPNSTSKSNKTSSKMTSRPESHSKATKVAVPPKDDDDESGEEYEEEEERDNTLCGSCGTNDGKDEFWICCDSCERWYHGKCVKITPARAEHIKHYKCPDCSNKRARA

SEQ ID NO: 11792 - protein, 426 aa, Catharanthus roseus
MGSSEETKSSKPEKSSSPAPEQSNVHVYPDWAAMQAYYGPRVAVPPYFSSAVASGHPPHPYMWGPPQPMMPPYGTPYAAIYAHGGVYTHPGVPLGSHANAHAGATSPGATEAIAASPLSIDTPTKSSANGSQGLMNKLRGFDGLAMSIGNGNTDSADGGTDHGISQSGDTEGSSDGSNGTTSKAGQKNKKRSREGTPANDRERKSLTPSSPSAAVNTNGSSEKAMRASKVPAAATEKVMGAVLSPNMTTASELRNPSAANAKTSPAKVSQSCSSLPGETWLQNERELKRERRKQSNRESARRSRLRKQAETEELAKKVQTLTAENMTLRSEINKLTENSEHLRHESALLDKLKNARVMQAGEMNKYDELHRQPTGTADLLARVNNSGSTDKSNEEGGGDVFENRNSGTKLHQLLDASPRADAVAAG

SEQ ID NO: 11793 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 11794 - protein, 243 aa, Mycoplasma hyorhinis
MSKTIIIGNWKMNKTFTQTKEFFSAFNQLYIENKNKINQNLDFAVALPAINVAAFSKNTTKLELAVQNMSQFEKGAYTGEISAQMLLDLNVKYAIIGHSERRQYFKETDLDVNAKTQQAIKNNIIPVVCVGETLEEYEAQKTSQVIEYQLKNSLKDVDLSKVIVAYEPIWAIGTGKTATPEQAQQVCKFIRKQTNKNLTILYGGSVSQENIEQLLNQADINGALVGGASLKVDSFIKLLTLNK

SEQ ID NO: 11795 - protein, 622 aa, Escherichia coli O157:H7 EDL933
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANQEVLYALNPMWAVHFFLEYKTVSFIALGAVVLSITGVEALYADMGHFGKFPIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVILLTLRTEDAPYVHNVRRVQIEQLSPTFWRVVASYGWRETPNVEEVFHRCGLEGLSCRMMETSFFMSHESLILGKRPWYLRLRGKLYLLLQRNALRAPDQFEIPPNRVIELGTQVEI

SEQ ID NO: 11796 - protein, 389 aa, Escherichia coli
TLQNGKLNVPENPIIPYFEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGTINAKTVTYDFERLMEGAKVL

SEQ ID NO: 11797 - protein, 498 aa, Solanum tuberosum
MKKVTVGAAVVGAAAVCAVAALIVNHRMRKSSKWGRAMAILREFEEKCKTQDAKLKQVADAMTVEMHAGLASEGGQSSRCLSPMSIISQLVMKLGVFYALDLGGTNFRVLRVQLGGKDGGIIHQEFAEASIPPSLMVGTSDALFDYIAAELAKFVAAEEEKFHQPPGKQRELGFHLLIPSNADFNNSGTIMRWTKGFSIDDAVGQDVVGELTKAMKEKVLDMRVSALVNDTVGTLAGGKYTQKDVAVAVILGTGTNAAYVERVQAIPKWHGPVPKSGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDTPKQGGSERTVIAMDGGLYEHYTEYRMCLENSLKDLLGEELATSIVFVHSNDGSGIGAALLRASHSMYLEDQA

SEQ ID NO: 11798 - protein, 524 aa, ASPERGILLUS NIDULANS FGSC A4
MSFLLRKLVHNEAMRTDPREIYGWRVYALACSACFGGMLFGVETGIIGGVLTMDTFKAKYGLNELGDTGRANLSANIVSTLQAGCFFGALAASWVADKYGRRLGLIAASFVALVGVIMQVAASGHLEAMYIGRLLCGIGVGFASMVNPLYVSENAPRAIRGGLTGLYQLFITMGIMLAFWINYGSLLHISGAGQYLVPLAMQGLPAILLLVGMLLCNESPRWLAKQDRWEEARATLSRVRNLPSTHPYVENEFQDIVRQLEFERQLISGSSFVDLLKEMWFIPGNRKRALISIWLMICQQMTGTNAINYYAPQIFENLGITGSANGLFATGVYGIVKVVGCACFLVFVADSLGRRRSLLWTSIAQGLAMLYIGLYVRIAPPKEGEPVIPAGYFALVCIFLFAAFFQFGWGPVCWIYVSEIPTTRLRSLNVSFAAATQWLFNFVVARAVPNMLATVGANGYGAYIIFACFCFSMFVFVWFFVPETKGLSLEKMDDLFGISHGSTKESADESPAEKQEEIRIEKTA

SEQ ID NO: 11799 - protein, 179 aa, Eremothecium sinecaudum
GAVGGPKWGVGSVRPEQGLLQLRKELGLYANLRPCSFPSESLVDLSPLKADLVRGADFTVVRELVGGIYFGERQEESGDGVAWDTESYSIPEIERIGRMAGYLALQHDPPLAVHSVDKANVLASSRLWRKTMDALFSKEFPQVTLHHQLVDSAAMLLVKSPRVFNGIVVTSNMFGDIIS

SEQ ID NO: 11800 - protein, 202 aa, Cicer arietinum
AIVNLISNPVNSTVPIAAEVFKRAGTYDPKKLLGVTMLDVVRANTFVAEVLGLDPRDVDVPVVGGHAGITILPLLSQVKPPSSFTPKEIEYLTDRIQNGGTEVVEAKAGAGSATLSMAYAAVKFADACLRALKGESGIIECAYVASQVTELPFFASKVRLGRDGVEEFLPLGPLSDYERESLEKAKKELATSVEKGISFTRQ

SEQ ID NO: 11801 - protein, 640 aa, Lolium multiflorum
MATATSTAVAFSGATATLPKPRTLPRHLLPSSRRALAAPIRCSAVSPSPSPAPPATALRPWGPSEPRKGADILVEALERCGISDVFAYPGGASMEIHQALTSSPLITNHLFRHEQGEAFAASGYARASGRVGVCVATSGPGATNLVSALADALLDSIPMVAITGQVQRRMIGTDAFQETPIVEVTRSITKHNYLVLDVEDIPRVIQEAFFLASSGRPGPVLVDIPKDIQQQMAVPVWDAPMSLPGYIARLPKPPATELLEQVLRLVGEERRPILYVGGGCSASGEDVRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNAVLTGSKCDKSFDFASWHDELEQQKREFPLGYKTFGEAIPPQYAIQVLDELTKGEAIIATGVGQHQMWAAQYYTYKRPRQVLSSAGLGAMGFGLPAAAGTAVANPGVTVVDIDGDGSFLMNIQELALIRIENLPVKVMILNNQHLGMVVQWEDRFYKANRAHTYLGNPENESEIYPDFVTIAKGFNVPAVRVTKRSEVRAAIKKMLETPGPYLLDIIVPHQEHVLPMIPSGGAFKDIIMEGDGRISY

SEQ ID NO: 11802 - protein, 550 aa, ASPERGILLUS NIDULANS FGSC A4
MGVESSSYHGESITPAPAPQPQQYSSQESIGSTKPEPGVDTPIPRITLRATIMGLFVSMGGLLFGYDTGQISGFQEMSDFLERYGELQSDGSYSFSHVRSGLIVSLLSIGTLIGALCGAPLADKLGRKWSITVWCIILMVGIIVQISAPSGNWVQIVMGRWTTGLGVGGCSLVVPMYQGESAPKHVRGAMISSYQLFVTLGIFLAYCINLGTESLDGSAQWRITLGLTFLFALILGLGMAMFPESPRFNYRHGKIDTARTTMARLYGVPENHVVIVRELAEIQSQLDAEKEQSQKWNEFITAPRMLYRILLGIVLQALQQLTGANYFFYYGTTIFQGAGISNSFITQVILGAINFGTTFGGLYVVENFGRRKSLIAGASLMFICFMIFASIGHFMLDVEHPENTPGPGKGMVVVASFFVLFYATTWGPIVWSIVAELFPSKYRAKGMALATASNWLWNFLIGCLSFFTPFITGAIDFAYGYVFAGCLLVAVFVVYFFVIEGKDRTLEELDWMYVNHVKPWESSKYEIPRITYHDDARGARKENTEHAEVA

SEQ ID NO: 11803 - protein, 106 aa, Zea mays
PRGLGREKKKKKKKRKKKKKKKKKKKKKKKKKKKGELFRVPLLGNQHPIGVEITKAAMELGPEKLSGLANDAYKDAPQRGVQAMKDRMADLAQSLEMPVALGDGLK

SEQ ID NO: 11804 - protein, 229 aa, Medicago sativa
MARGKIQIKRIENTTNRQVTYSKRRDGLFKKANELTVLCDAKVSIIMFSSTGKLHEYISPSASTKQFFDQYQMTVGIDLWNSHYENMQENLKKLKDVNRNLRKEIRQGMGECLNDLSMEELRLLEDEMDKAAKAIRERKYKVITNQIDTQRKKSNNEREVHNRLLRDLDARAEDPRFEMMDNGGEYESVIGFSNLGPRMFALSLQPTHPNPHNGGASAASDLTTYPLLF

SEQ ID NO: 11805 - protein, 821 aa, Thermotoga neapolitana
MGAALCERILGRQQGSGQSHHQKPVAEGNQKIHMGTRRMRRESYGTVQDPSQPVEVRVKDLLSRMTLEEKIAQLGSVWGYELIDERGKFKREKAKDLLKNGIGQITRPGGSTNLEPQEAAELVNEIQRFLVEETRLGIPAMIHEECLTGYMGLGGTNFPQAIAMASTWDPDLIEKMTAAIREDMRKLGAHQGLAPVLDVARDPRWGRTEETFGESPYLVARMGVSYVKGLQGENIKEGVVATVKHFAGYSASEGGKNWAPTNIPEREFREVFLFPFEAAVKEARVLSVMNSYSEIDGVPCAANRRLLTDILRKDWGFEGIVVSDYFAVNMLGEYHRIAKDKSESARLALEAGIDVELPKTDCYQHLKDLVEKGIVPESLIDEAVSRVLKLKFMLGLFENPYVDVEKAKIESHRDLALEIARKSIILLKNDGTLPLQKNKKVALIGPNAGEVRNLLGDYMYLAHIRALLDNIDDVFGNPQIPRENYERLKKSIEEHMKSIPSVLDAFKEEGIDFEYAKGCEVTGEDRSGFKEAIEVAKRSDVAIVVVGDRSGLTLDCTTGESRDMANLKLPGVQEELVLEIAKTGKPVVLVLITGRPYSLKNLVDRVNAILQVWLPGEAGGRAIVDVIYGKVNPSGKLPISFPRSAGQIPVFHYVKPSGGRSHWHGDYVDESTKPLFPFGHGLSYTRFEYSNLRIEPKEVPSAGEVVIKVDVENVGDMDGDEVVQLYIGREFASVTRPVKELKGFKRVSLKAKEKKTVVFRLHTDVLAYYDRDMKLVVEPGEFRVMVGSSSEDIRLTGSFSVTGSKREVVGKRKFFTEVYEE

SEQ ID NO: 11806 - protein, 337 aa, Thanatephorus cucumeris
MAVKIGINGFGRIGRIVLRNAILHGDIDVVAVNDPFIALDYMVYMFKYDSTHGRFKGQVEAKDGKLIIEGKPVAVHSERDPSTINWGDAEYVVESTGVFTTVEKASAHFKASPNLKKVVISAPSADAPMYVVGVNLDAYDPKGPKISNASCTTTCLGPLDKVINDEFGIVEGLMTTVHATTATQKTVDGPSAKDWRGGRGAAANIIPSSTGAAKAVGKVIPSLNGKLTGLAFRVPTSDVSVVDLVVRLEKSASYDEIKAALKKASEGEYKGIIGYTEDDVVSTDFVGDEHSSIFDAKAGISLNKNFVKLVSWYDNEWGYSRRVVDLIAHIAKKDAEA

SEQ ID NO: 11807 - protein, 459 aa, Chrysochromulina alifera
DPDYVIKETDLLALFRCTPQPGVDPVEAAAALAGESSTATWTVVWTDLLTACDLYRAKAYRVDPVPNASDTYFCYIAYDIDLFEEGSLANLTASIIGNIFGFKAVKALRLEDMRFPYALLKTFQGPATGLVVERERMDKFGRPLLGATVKPKLGLSGKNYGRVVFEGLKGGLDFLKDDENINSQPFMRYRERFLYSMEGVNHASSMSGEVKGHYLNTTGATMEDMYERADFAAELGSIVVMIDLVIGYTAIQSMAIWSRKNDVILHLHRAGNSTYSRQKNHGMNFRVICKWMRMAGVDHIHAGTVVGKLEGDPLMIKGFYNTLLDTKTDINLPEGLFFAQDWASLRKCVPVASGGIHCGQMHQLIDYLGEDCVMQFGGGTIGHPDGIQAGATANRVALECMVLARNEGRDYTNEGPQILRDAAKSCGPLQTALDLWKDITFNYASTDTADFATTATANV

SEQ ID NO: 11808 - protein, 322 aa, Synechocystis sp. PCC 6803
MEQPMKPTVIITGASSGVGLYGAKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 11809 - protein, 215 aa, Oryza sativa
  unsure (1)..(215): unsure at all Xaa locations
MEKAACNEHVIGIPVSNRAFGIEEPDFPSEGAAAYHAEAKSSATARTSSRFGRTGDRLAQGIKEHVTLGPKLYETMKGKLTLGATILQAGGVEKVFRRXFAVTRXEKLLRASQCYLSTTAGPIAGMLFISTERIAFRSDRSLALTTPSGDTVRVPYKVAIPLRRVKTAKPSENKHRPEQKYVQVVTDDGFEFWFMGFVSFQVTLKNLELAVAQAQ

SEQ ID NO: 11810 - protein, 469 aa, Pseudomonas aeruginosa PAO1
MSYKSHQLIKDHDVKWVDLRFTDTKGKQQHVTMPARDALDDEFFEAGKMFDGSSIAGWKGIEASDMILMPDDSTAVLDPFTEEPTLILVCDIIEPSTMQGYERDPRNIAKRAEEYLKSTGIGDTVFVGPEPEFFIFDEVKFKSDISGSMFKIFSEQASWNTDADIESGNKGHRPGVKGGYFPVPPVDHDHEIRTAMCNALEEMGLVVEVHHHEVATAGQNEIGVKFNTLVAKADEVQTLKYCVHNVADAYGKTVTFMPKPLYGDNGSGMHVHMSISKDGKNTFAGEGYAGLSETALYFIGGIIKHGKALNGFTNPSTNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFTDEFIDAYIELKSEEEIKVRTFVHPLEYDLYYSV

SEQ ID NO: 11811 - protein, 317 aa, Erwinia sp. SK-30-7
  unsure (1)..(317): unsure at all Xaa locations
CIGCHTCAVTCKNVWTSREGMEYAWFNNVETKPGTGYPTDWENQEKWKGGWIRKINGKLQPRMGNRAMLLGKIFANPHLPGIDDYYEPFDFDYQHLHNAPAGKHQPIARPRSLITGQRMNKIEKGPNWEXDLGGEFEKLSKDQNFQNMQKAMYGQFENTFMAYLPRLCEHCLNPACAATCPSGAIYKREEDGIVLIDQDKCRGWRMCITGCPYKKIYFNWKSGKSEKCIFCYPRIEAGQPTVCSETCVGRIRYLGVLLYDADAIEQAASTENEKDLYERQLGIFLNPNDPAVIEQALKECVPRSVIDAAQQSPVYKM

SEQ ID NO: 11812 - protein, 235 aa, Triticum aestivum
VFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 11813 - protein, 67 aa, Zea mays
EPVNDAMKVFQSCSDSRSEIRSRGDRDIDNQQALQAEDKDVVSSVATVLSDLCGPGEWMPMAKLHNE

SEQ ID NO: 11814 - protein, 299 aa, Oryza sativa (japonica cultivar-group)
MAPLRTLVIFLLLLLALVPALSRPDGGGGGFYDPARVTQLSWRPRAFLYSGFLSHDECDHLVNLAKGRMEKSMVADNDSGKSIMSQVRTSSGTFLSKHEDDIVSGIEKRVAAWTFLPEENAESIQILHYELGQKYDAHFDYFHDKNNLKRGGHRVATVLMYLTDVKKGGETVFPNAAGRHLQLKDETWSDCARSGLAVKPKKGDALLFFSLHVNATTDPASLHGSCPVIEGEKWSATKWIHVRSFDNPPDVSLDLPCSDENERCTRWAAVGECYRNPKYMVGTKDSLGFCRKSCGVCDA

SEQ ID NO: 11815 - protein, 150 aa, Triticum aestivum
  unsure (1)..(150): unsure at all Xaa locations
MAAPMLNQPNGLLANMFAAGLLDDQFQELQMLQEGSAPDFIVKVVSLFCEDGERIIGEIAKLLDKPCVDYDKVGGFVHQLKGSSASLGAQRVKNSCIQFQQCCQEKSRDGCLNSLQSVRNDFYDLCSMFKXMLQLCQQVQALILKYRLER

SEQ ID NO: 11816 - protein, 594 aa, Glycine max
  unsure (1)..(594): unsure at all Xaa locations
MNHLPRIFGNRKKQASDMDPTKKKKKSKGKKHQQPKLERRNAAKHFEYDAGSLCSSRDEYDASTSSSSSLHCTRSMELFDRKSFRIEGVEGEFDQICRSLGLSGPEDFSIPAAAWEAMKLRCSSDLLPRRPKHGGEEEEFDEEPKEKEKEEVEIAVLESEDRARVLDECVVPAESSGCCGGIKGFRPPMLKPPPGVRVSVVDDATCSTWDLMRDFAPKGEGGGKDSYVELNSSDDEDDHEREEKEEEEDEEDEEEEEGEVGGVRVESVEEENAAAIAEIVGDFSGFSTSNEDDSSSTSTGPRSNNISPNGRIKRVITAGNWQKGDLLGRGSFGSVYEGISEDGFFFAVKEVSLLDQGNQGRQSVYQLEQEIALLSQFEHENIVQYIGTEMDASNLYIFIELVTKGSLRNLYQRYNLRDSQVSAYTRQILHGLKYLHDRNIVHRDIKCANILVDANGSGKLAXDFGLAKATKFNDVKSCXGTAFWMAPEVVKGKNTGYGLPADIWSLGCTVLEMLTGQIPYSHLECMQALFRIGRGEPPHVPDSLSRDARDFILQCLKVDPDERPSAAQLLNHTFVQRPLHSQSSGSASPYIRRG

SEQ ID NO: 11817 - protein, 245 aa, Zea mays
  unsure (1)..(245): unsure at all Xaa locations
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDXGMQERTIITSSLSKTYSVTGWRLGWACAAASIASAIRNIHIKLTDSAP

SEQ ID NO: 11818 - protein, 195 aa, Triticum aestivum
YMGSQTEINPKMRAILTDWLVEVTHKFELMPESMYLTIYVIDRFLSLQAVPRRELQLVGIAAMLIACKYEEIWAPEVNDFISIADNSYSRQQILSMEKNILNSMAWNLTVPTPYVFLVRFAKAAGSDKELEHMIFFFAELALMEYGLVTVRPSLGGKLLAVYPCPGAPPEKEAPFWTGNPSSTQTGIRLKPQASG

SEQ ID NO: 11819 - protein, 530 aa, Poncirus trifoliata
MIESGAYNNYTLVQDPLLESRKRSLALTGLLLVLIYFGSTMIPNIWTAFKFTGATTAVSLGFIFPPLVALRLRKEGPGLSLGEKFLSGLMLVLAILGWLLTHSLIAKAVVAACIGAKFGIDGNPGELPKWYAIVVVLFFYIYVAGFAWSWGPLGWLVPSEILPLKIRSAAQSVNVSVNMLCTFLVAQVFLNKLCHLKFGLFLFFGFFVMVMSFFIYFFLAETKGIPIEEMDWLTNDCTDNDENTTLHKLLQLHKLLRLRSPFFLLQDLRSQKQITGAGGFFGKNPPMLNGLGRGETIALLRDRAFFLNDKLLVGMRLCNVGPSSRKNTLRYSQPEAIPPPYDCELNGNRGGQASGSGENRSSDGTEIPGEKGGNEETIQSLGGDIHLPTRFVTPRRLFFFTLHVSGRHLFVYLTLSMFSDSWGLVSKLDDEPLVKVEIALVNAFNCQDLLSPTSLVESRLVDVVAGMDNKIPSAMSRKRAQVSGESSIAPFSQKKSNTGPSKTSAPALLNIVNKEASGVRTLHGNNCITE

SEQ ID NO: 11820 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAILVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 11821 - protein, 360 aa, Cicer arietinum
LERHELVPTVWNEYGWDKVSNILYVDQPTGTGFSYSSDLRDIRHNEKGVSNDLYDFLQAFFAEHPQYAKNNFFITGESYAGHYIPALASRIRQGNQAKEGIHINLKGLAIGNGLTNPAIQYKAYADYALDMGIITKATHDRLGLVLVPACELAIKLCGTDGKLACLTANVACNLIFSDILLHAGDVNYYDIRKKCEGSLCYDFSNMEKFLNQESVRDSLGVAKISFVSCSTEVYIAMLVDWMRNLEVGIPILLEDGINLLVYAGEYDLICNWLGNSRWVHAMEWSGQKKFVASPDVPFVVNGSEAGLLKNYGPLSFLKVYDAGHMVPMDQPKAALEMLKKWTRGTLAESKVGEEEFVADM

SEQ ID NO: 11822 - protein, 242 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRMKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAASNGTTDGGNKRKAAAMEEEGMLAVMTVAAPESSTKPRLSTTTSSLAVET

SEQ ID NO: 11823 - protein, 453 aa, Cytophaga hutchinsonii
MKEYFYKKISQLDYKEFHRTAYQLIPLWVASVLVGVAAVMYARGFLYVEDLSTEFLHTYPEAIFAISPVAFLSSWFLVKVFAPMAAGSGIPQVMAAVELEGKSNLSRKLLNVKVSIVKVLSSLVMLAGGGAIGREGPTIQISASIFSFMHHALPKQWEKFSAQLMVLTGAASGLAAAFNTPLGGIVFAIEELTRIQFSKFRTTLFVAVIISGMTAQAMLGPYLYLGFPKVQVAGYSYILWVIAAAALAGFMGGMFGSLILVIHRWKKTIKTTGKHIAIVLIFALSFASIYYFFNRSVIGAGKEVMEDLLFISNKDVSPSLVLSRFFGPILSFGSGGAGGIFAPSLCAGSTIGAFIAYVADIPSEFTNLLILAGMVGFLTGVTHSPFTSAILVLEMTDRHSVIFYLMLAGMFAYLVSMLVDKKSVYEHLKEGYLNSFLPPEGKTPEPTETDVAK

SEQ ID NO: 11824 - protein, 192 aa, Streptomyces lividans
MTSVLMIDNCDSFTYNLVDQFSPHGTIVIVKRNHPFYDGEIEAIMALTSICITPGPCYPAEAALNSCSIIGHLAGRIPILGICLGQQALGQARGGLVIFAHGKLSNIEHNGIFAPLFNPPRALPAGRYHSLVVEPARIEVTGQCNQLEVVPQEIMAIRHRDLPVEGVQFHPESILSSNGAAILANLIHRPCH

SEQ ID NO: 11825 - protein, 446 aa, Chondrus pinnulatus f. armatus
  unsure (1)..(446): unsure at all Xaa locations
LFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKALGSIIVMXXXXXXXXXXXXMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGVDVVLQFGGGTIGHPDGIQAGATANRVALESMVIAXXXGRDFVAEGPQILQDAAKTCGPLQTALDLWKDISFNYTSTDTADFVETPTANV

SEQ ID NO: 11826 - protein, 443 aa, Shigella flexneri 2a str. 301
MCVPEMIKKELVMVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 11827 - protein, 293 aa, Pisum sativum
MGSSFWTVCLILASLVSSSFCALPRKPVDVPFGRNYYPTWAFDHIKYFNGGSEIQLHLDKSTGTGFQSKGSYLFGHFSMNIKMVPGDSAGTVTAFYLSSQNAEHDEIDFEFLGNRTGQPYILQTNVFTGGQGNKEQRIFLWFDPTKEFHRYSILWNMYQIVFYVDDVPIRVFKNSKDLGVKFPFDQPMKIYNSLWNADDWATRGGLEKTDCSKAPFIAGYKSFHIDGCEASVNSKFCATQGMRWWDQAEFRDFDAAQWRSLKWVREKYTIYNYCTDRKRLPQIPSECKRDGDI

SEQ ID NO: 11828 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 11829 - protein, 377 aa, Zea mays; identical to SEQ ID NO: 4317

SEQ ID NO: 11830 - protein, 242 aa, Mycoplasma flocculare
MKKIIIGNWKMNKTVHETRDFIQKFDIFYSKNLGKIKDNLDFAIAPSFTSLALISTSKIDKLKVAAQNLSQFDSGAFTGEISAKMLQDLAVHYVIIGHSERREIFKEIGEDLTNKILQAQKYNLIPVFCVGESLSEFEANETEKVIIGQINEVKSVLNFEKAIIAYEPIWAIGTGKTATAQIAEQVCKLIKNNFGKNIRVIYGGSVNSKNINELLLQKNIDGALVGKASLDPEEFVKILANI

SEQ ID NO: 11831 - protein, 759 aa, Arabidopsis thaliana
MWRLKIGEGNGDDPYLFTTNNFAGRQTWEFDPDGGSPEERHSVVEARRIFYDNRFHVKASSDLLWRMQFLREKKFEQRIAPVKVEDSEKVTFETATSALRRGIHFFSALQASDGHWPAENAGPLFFLPPLVFCLYITGHLDEVFTSEHRKEILRYIYCHQKEDGGWGLHIEGHSTMFCTTLNYICMRILGESPDGGHDNACGRAREWILSHGGVTYIPSWGKTWLSILGVFDWSGSNPMPPEFWILPSFFPVHPAKMWSYCRMVYLPMSYLYGKRFVGPITSLILQLRKELYLQPYEEINWMKVRHLCAKEDTYYPRPLVQELVWDSLYIFAEPFLARWPFNKLLREKALQLAMKHIHYEDENSRYITIGCVEKVLCMLACWVEDPNGDYFKKHLSRISDYLWMAEDGMKMQSFGSQLWDTGFAMQALLASNLSSEISDVLRRGHEFIKNSQVGENPSGDYKSMYRHISKGAWTFSDRDHGWQVSDCTAHGLKCCLLFSMLAPDIVGPKQDPERLHDSVNILLSLQSKNGGMTAWEPAGAPKWLELLNPTEMFSDIVIEHEYSECTSSAIQALSLFKQLYPDHRTTEITAFIKKAAEYLENMQTRDGSWYGNWGICFTYGTWFALAGLAAAGKTFNDCEAIRKGVQFLLAAQKDNGGWGESYLSCSKKIYIAQVGEISNVVQTAWALMGLIHSGQAERDPIPLHRAAKLIINSQLESGDFPQQQATGVFLKNCTLHYAAYRNIHPLWALAEYRARVSLP

SEQ ID NO: 11832 - protein, 505 aa, Agrobacterium tumefaciens str. C58
MNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 11833 - protein, 451 aa, Eucheuma uncinatum
TDVLALFRVSPQPGVDPIEASAAVAGESSTATWTVVWTDLLTACDLYRAKAYKVDRVPNTSDQYFAFIAYDIDLFEEGSIANLTASIIGNVFGFKAVKALRLEDMRIPVAYLKTFQGPATGLISERERMDKFGRPFLGATVKPKLGLSGKNYGRVVYEGLRGGLDFLKDDENINSQPFMRWKERFLYAMEAVNRSIAATGEVKGHYLNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 11834 - protein, 392 aa, Methanosarcina barkeri
MKACIMCGGAGTRLRPLTFKHPKPSIPILNKPSVRHLIEHLSREGFNEIVMTLGYMGERIEEQLGDGHMFGVHIDYVYEKEKLGTAGGVKNAEEYLKDEPFIVLGGDHVLNLDLREMYRFHEANDAPVTIGLLSIDDPREFGIADMDINNRIHRFLEKPKAGQIFSNLASTGIYICSPSIFEWIPKGKKYDFAKDLFPFMLAADKKINGVLVRGKWTDVGSSAAYRQAQRWMLDALPGTTIEGNFTTRNARIKGPLSIGNNVCIGSNSSLVGPIVIGENTTIGDNVLIGPYSVIGSNCTIENNTKILSSYLFDNVFIGKDSNLSGGVVSDETIIGEHCFLENGTVIGHKVLIGSNSTIHSGVKIWPEIVIDKNSSIQETVINSGYDAAHEGS

SEQ ID NO: 11835 - protein, 395 aa, Halobacterium sp. NRC-1
MRTTHLNPMIPERRPREGILKDGPAVTPSMELRDLSDHVEYRAGRGIEEVARELGRDPSEFVKLSSNENPHGPSPKATIAIREAATGVHRYPKAVHADLTGALADRWDVGDDQVWVANGGDGALDYLARATLDPGDSVLVPSPGFTYYGMSARFHHGNVAEYDVAEGADGFEMTADAVVDAYDGERVVYLTTPHNPTGARFTLDEIVAVADRTDEDTLVLVDEAYGEFTETPSAVTLFDGQPAGGHAPRDDIAVLRTFSKAYGLAGIRLGYAVVPDSWADAYARVQTPFAASVIACQAGVAALDDDDHVEATTDSVAWGRDYIHDELAARTYESHGNFVLANVGDAGRVAEAAKREGVLVRDCTSFGLPEHVRITIGTRSETERAVAVLNEVCDT

SEQ ID NO: 11836 - protein, 480 aa, Oryza sativa; identical to SEQ ID NO: 4634

SEQ ID NO: 11837 - protein, 520 aa, Ostreococcus tauri
MVKTASSSSGRFESRASASMTSRAREMEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGGPTRVRLGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 11838 - protein, 607 aa, Arabidopsis thaliana
MDTKIGSIDACNPTNHDIGGPPNGGVSTVQNTSPLHSTTVSPCDATLGRYLARRLVEIGVTDVFSVPGDFNLTLLDHLIAEPNLKLIGCCNELNAGYAADGYARSRGVGACVVTFTVGGLSVLNAIAGAYSENLPLICIVGGPNSNDYGTNRILHHTIGLPDFTQELRCFQAVTCFQAVINNLEEAHELIDTAISTALKESKPVYISISCNLPAIPLPTFSRHPVPFMLPMKVSNQIGLDAAVEAAAEFLNKAVKPVLVGGPKMRVAKAADAFVELADASGYGLAVMPSAKGQVPEHHKHFIGTYWGAVSTAFCAEIVESADAYLFAGPIFNDYSSVGYSLLLKKEKAIIVQPDRVTIGNGPAFGCVFMKDFLSELAKRIKHNNTSYENYHRIYVPEGKPLRDNPNESLRVNVLFQHIQNMLSSESAVLAETGDSWFNCQKLKLPEGCGYEFQMQYGSIGWSVGATLGYAQAMPNRRVIACIGDGSFQVTAQDVSPMIRCGHKTIIFLINNGGYTIEVEIHDGPYNVIKNWNYTAFVEAIHNGEGKCWTPKVRCEEELVKAINTATNEEKESFCFIEVIVHKDDTSKELLEWGSRVSAANSRPPNPQ

SEQ ID NO: 11839 - protein, 225 aa, Zea mays
EDNACDLRRGILLGKNGTANFPFSSVFSLPFLSSLISCGRRTMASTTDFTKSLLSPFSQHGFNSQRGSSRQNKNATWPNQHKPNRSLRVNGLFGGGNNKDNNNTEDGQSKAGGIFGNMQNMYETVKKAQMVVQVEAVRVQKELAAAEFDGYCEGELVKVTLSGNQQPIRTDITEAAMELGSEKLSLLVTEAYKDAHAKSVVAMKERMSDLAQSLGMPPGLSEGMK

SEQ ID NO: 11840 - protein, 325 aa, Nostoc punctiforme
MSNSRVLCLGEILFDCLADQLGLKLEEVKSWTPYPGGAPANVACALVKLGTTAGFIGAVGEDEPGNALVKLLQDVGVDTTGVQRHPTAPTRQVYVTRDLAGDRTFAGFGQYDTAEFADTRLQAKQLPDALFQEADFLVLGTLELAYPESEQAIYRALELAEHYDLKIVLDINWRPVFWDEPKIAHQKIPELFKRVDFLKLSKEEAEWLFETADPGAITYRLASIEGVLVTDGENGCTYCLGENEGKLPSFSIPVVDTTGAGDSFLAGFIHQLSHYGIHSLRDAETAKRIVTYASAVGALTTIKPGAIASQPTDAEVEAFLASHQL

SEQ ID NO: 11841 - protein, 126 aa, Zea mays; identical to SEQ ID NO: 9768

SEQ ID NO: 11842 - protein, 299 aa, Photobacterium profundum
MGYSHASHLDSLNQNIADINGDINVSFEFFPPSSEKMEETLWHSIHRLKTLKPKFVSVTYGANSGERDRTHSIIKDIKDQTGLIAAPHLTCIDASRDELRTIARDYWRNGIRDIVALRGDLPAQGTKPDMYAADLVELLRKEADFDISVAAYPEVHPEAKSAQADLINLKRKVDAGASRAITQFFFDVESYLRFRDRCVAAGIDVEIVPGILPVSNMTQAKRFAVANNVKIPGWLEKQYQGLDDDLLSRQMLGASNAIDMVRVLSREGVKDFHFYTLNRAELTYAICHTLGVRAEVEAK

SEQ ID NO: 11843 - protein, 411 aa, Oceanobacillus iheyensis HTE831
MANLRDEALHLHKVKQGKLEINTKVPVKDAKDLSLAYSPGVAEPCKEIYDRKETVYDYTMKGNMVAVVSDGSAVLGLGNIGPEAALPVMEGKAVLFKGFAGVDAFPICVDTHDVEQIVQTVKLLEPNFGGVNLEDIAAPNCFIIEDRLKSETNIPIFHDDQHGTAIVTVAGLINALKLVGKKFSDIKVVANGAGAAGIAIIRLLQSFGVRDMIMCDSKGAIYEGRPYGMNTVKDSVAKYTNANKVEGSLSDVLEGADVFIGVSVGGALTKDMVRSMNDDAIIFAMANPDPEILPEDAKEAGARVIGTGRSDFANQVNNVLAFPGIFRGALDVRATRINEEMKVAAAEGIATLISDDELHDDYVIPSPFDERVAPLVASHVAKAAMSTGVARMNVDPEEVAEKTRKLTQQEK

SEQ ID NO: 11844 - protein, 433 aa, Arabidopsis thaliana
MTLMVMVLCSIASGLSFGSNPKTVMTTLCFFRFWLGFGIGGDYPLSATIMSEYANKKTRGAFIAAVFAMQGFGILTGGIFAIIVSAAFEAKFPAPTYQIDALASTVPQADYVWRIILMVGALPAAMTYYSRSKMPETARYTALVAKDAKLAASNMSKVLQVEIEAEQQGTEDKSNSFGLFSKEFMKRHGLHLLGTTSTWFLLDIAFYSQNLFQKDIFSAIGWIPPAQTMNAIQEVFKIARAQTLIALCSTVPGYWFTVAFIDVIGRFAIQMMGFFFMTVFMFALAIPYDHWTHKENRIGFVAMYSLTFFFANFGPNATTFVVPAEIFPARFRSTCHGISAASGKLGAMVGAFGFLYLAQSPDKTKTEHGYPPGIGVKNSLIVLGVVNLLGMVFTLLVPESKGKSLEEMSGENEQNDESSSSSNNNSNNAVSTA

SEQ ID NO: 11845 - protein, 523 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIVGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 11846 - protein, 410 aa, Bifidobacterium longum DJO10A
MTPGVAFFYGGMVRAKAVLNMLMLEAAALSVTMIIWTLWGWSIAYAGSDIGGIFGDPASGFLLKDSMVAQDGVFTATGLNGNNYPVSVDVAFQVAFAMITVGLICGAIAERVKYSTWMIFVALWVTFDYAPMAHMVWNGGLLSADGAISKAIGAAAHDFAGGTVVHINAAVAALIIVLIIGKRKGFGTQPFRPHNVPFVMLGAFLLWFGWFGFNAGSAFAANGTAGYAWVSTSAATAAAMLSWGFTEKIRSGHYTAMGAASGMVAGLVAITPAADVVSPLWAIVMGAIAGVLTCLACGLKFKFGYDDSLDVVGVHGVGGFTGTILIGFFGEGTGLLAGGDWRQLVVQLVIALVAILYSAVITAIIAFALEKTIGWRVTEAQEVGGIDLADQGERAYDFAGTASSVLKEVK

SEQ ID NO: 11847 - protein, 412 aa, Medicago sativa
MMASGGVAPASGFIDKNASSVGVEKLPEEMNDMKIRDDKEMEAATIVDGNGTETGHIIVTTIGGKNGQPKQTISYMAERVVGHGSFGVVFQAKCLETGETVAIKKVLQDKRYKNRELQTMRLLDHPNVVSLKHCFFSTTEKDELYLNLVLEYVPETVSRVIRHYNKMNQRMPMIYVKLYSYQICRALAYIHNSIGVCHRDIKPQNLLVNPHTHQLKICDFGSAKVLVKGEPNISYICSRYYRAPELIFGATEYTTAIDIWSAGCVLGELLLGQPLFPGESGVDQLVEIIKVLGTPTREEIKCMNPNYTEFKFPQIKAHPWHKIFHKRMPPEAVDLVSRLLQYSPNLRSTALEALVHPFYDDVRDPNTRLPNGRFLPPLFNFKVNELKGVPAEMLVKLVPPHARKQCALFGSS

SEQ ID NO: 11848 - protein, 374 aa, Prochlorococcus marinus subsp. pastoris str. CCMP1378
MDKFNTNNLNNKGIKEINFKHGGNILTQAKKLNLLPSKIIDSSASLVPFEPPKLILDVLISEIKTLGFRYYPERNLNSLREIIGEFHQINPDNILPGNGASELITWAGYEASKSGASCIPSPGFVDYERSLNCWNASFDYSELPKNWSNSFPQTFPIKPICDVLWITNPHNPTGQLWDKKSLEIILKKYKLVICDEAFLAITPNGEKESLIPLTKKYDNLLVIRSLTKLFNIAGLRLGYIIGSSEKLKKWNIKRDPWPLNSFAIKAGIELLSNKILYEEWTSMIHNWVNTEKNWVSNELSKIKNLKVHNSSTNFFLIESKFSLSSNIHYLEKKGILIRECNSFRFLNEKWARISLQTRKNNKILCREIQNSFKK

SEQ ID NO: 11849 - protein, 649 aa, Oryza sativa
  unsure (1)..(649): unsure at all Xaa locations
MPQYQELPCGGQVLDIDTALKDGILGGGPELGDAAAGDGGKQPVELRKMMDELDAAGDGGGDEAVPAVFICPISLEPMVDPVTLCTGQTYESANISRWLALGHRTCPTTMQELWDVTPIPNTTLRQLIAAWFSRRYTRFKKRSADFHGRAAELVHALRGTGVPKRQPLKGQGRVAALRELRSLAAGHQSVTKAIAXEAGGVGLLTSLLGPFTSHAVGSEAVAILVSGVPLDADAKAALMQPAKVSLLVDMLNEGAVDTKINCVRLIRILMEEKGFRPDTVASLSLLVGVMRLVRDKRHPDGVAAGLELLNSICAVHKPARSLIVSIGAVPQLVELLPELPTECVEPALDILDALAAVPEGRIALKDCPRTITNAVRLLMRVSEACTRRALSMLWVVCRMAPEECAPAALDAGLGAKLLLVIQSGCGPELKQQASELLKLCTMNCTSTVFISKCKLTKTIHIQNAAYTQLIQWQAGGMYMQIDEDFGQLNKHSRLGGAAIYSGSPAVRRWHWLVYTPTLVVGLVAAAGHLSVTVRWALHDRGDEVGASGWLPPSGSGSGSGAWGGFIDLQSGNRSNETSEAFAASLASGSRPVCVRPKWPHLTGKTDHITRRRHASISPQLFSALVSRTPDARCFSQNSTNAFNFTLFMV

SEQ ID NO: 11850 - protein, 266 aa, Hordeum vulgare subsp. vulgare
APQGAEVTGLPGFDGALPSKHYAGYVTVDEGHGRNLFYYVVESERDPGKDPVVLWLNGGPGCSSFDGFVYEPGPFNFESGGSVKSLPKLHLNPYAWSKVSTMIYLDSPAGVGLSLYSKNSDYETGDLKTATDSHTFLLKWFQLYPEFLSNPFYIAGESYAGVYVPTLSHEVVKGIQGGAKPTINFKGYMVGNGVCDTIFDGNALVPFAHGMGLISDEIYQQASTSCHGNYWNATDGKCDTAISKIESLISGLNIYDILEPCYHSRS

SEQ ID NO: 11851 - protein, 667 aa, Zea mays
GEPQLVHLRDLLAGGRRRGHLGRRRRRPPQQGGPHQERQADQVGAAPQGAARRRVAAGRTDAEAGVVAAAGESPVVRSRFYAFIKAFLVVSLLLLAVEVAAYFNGWDLAASALALPAIGLESMYASWLRFRATYVAPGIQFLTDACVVLFLIQSADRLIQCLGCFYIHIKRIKPKPKSLALPDAEDPDAGYYPMVLVQIPMCNEKEVYQQSIAAVCNLDWPKSNFLVQVLDDSDDPLTQTLIREEVAKWQQQGARIVYRHRVLRDGYKAGNLKSAMSCSYVKEYEFVAIFDADFQPHPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKIAFWKKANLIFLFFLLRKLILPFYSFTLFCIILPMTMFVPEAELPDWVVCYVPALMSLLNILPSPKSFPFIIPYLLFENTMSVTKFNAMISGLFQLGSAYEWVVTKKSGRSSEGDLIALAPPKEPVKLHATRTGSAPNLDAVAKEEHLAAASRKDAAAAAATVKKKKEKHNRIYKKELALSMLLLTAAARSLLSKQGIHFYFLLFQGVSFLLVGLDLIGEQVE

SEQ ID NO: 11852 - protein, 466 aa, Salmonella typhimurium LT2
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 11853 - protein, 319 aa, Staphylococcus aureus subsp. aureus MW2
MRRLFSIGEALIDFIPNITNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 11854 - protein, 201 aa, Zea mays
LLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 11855 - protein, 333 aa, Pseudomonas fluorescens PfO-1
MTLRIAINGFGRIGRNVLRALYTQGYRQDLQIVAINDLGDSAINAHLLKYDTVHGTFDAEVAHDNESLTVNGDRISVSAIRNPADLPWAAEKIDVVFECTGLFTDRAKAAAHITAGARKVIISAPAKGADATVVYGVNHDILRQSHQIISNASCTTNCLAPVAQVLHRELGIESGLMTTIHAYTNDQNLTDVYHTDPYRARSATQNMIPSKTGAAEAVGLVLPELAGKLTGMAVRVPVINVSLVDLTVQLKREASADEVNALMKAASQHSKILGFNTLPLVSSDFNHNPLSSIFDANHTKASGKLLKVLAWYDNEWGFSNRMLDNCLALCNAE

SEQ ID NO: 11856 - protein, 337 aa, Oryza sativa
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 11857 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 11858 - protein, 492 aa, Prochlorococcus marinus str. MIT 9313
MTTAPLPRSRRRTVRLQEASLLEGPMLLLRSIRGFSSNRSLTWLACVPLALFGLGLFNLSAHAAEMPELNAAFLANNLWLLVATILVIFMNAGFAMVEAGMCRQKNAVNILAKNLFVFALAVSSYWFIGYSLMYGDPVSAGWLYFNGLFFDPAVTPELISEAGLVPSVDFLFQAAFAGTAATIVSGLVAERVKFGEFVVFSLVLTGFIYPIAGSWEWNGGWLNTAFGEGVEFIDFAGSSIVHSVGAWAGLVGAMLLGPRIGKFVGGKAQAIPGHNMSIATLGALILWIGWYGFNPGSQLAMDQWVPYVAVTTTLAAAGGAIGATIISTLCSGKPDLTMIINGILAGLVSITAGCGNLTLVGAWVAGLIGGFIVVFSVSALDSLGIDDPVGAFSVHGICGIWGTLVIGLWGFDIQGDGSALGLFVGGGASQLWAQFVGCAAYAIWTVVTCWIAWSVIGALFGGIRVTEAEEIEGLDIGEHGMEAYPDFASAGN

SEQ ID NO: 11859 - protein, 310 aa, Staphylococcus cohnii
GFGRIGRLAFRRIQDVEGIDVVAVNDLTDDEMLAHLLKYDTTQGRFTGEVEVEENGFRVNGLEVKSFSEPDPSKLPWGDLDIDVVLECTGLFTDKEKAEAHINAGAKKVLISAPAKGDLKTIVYNTNHDTLDGSEDVVSGASCTTNSLAPVAKVLNGEFGLIEGFMTTIHAYTGDQSTQDAPHRKGDKRRARAAAENIIPNSTGAAKAIGLVIPEIDGKLDGGAQRVPVATGSLTELTVVLDKNVSIEDVNNAMKNASNESFGYTEDEIVSSDVIGMTYGSLFDATQTRVMTVGDRQLVKVAAWYDNEMS

SEQ ID NO: 11860 - protein, 179 aa, Oryza sativa
  unsure (1)..(179): unsure at all Xaa locations
MASDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRXDLGEALRRIREGAAMIRTKGEAGTGNVVEA

SEQ ID NO: 11861 - protein, 332 aa, Streptomyces coelicolor A3(2)
MTRIGINGFGRIGRNVLRALLERDTKLEVVAVNDLTEPATLARLLAFDSTAGRLGRPVTVDGDTLVVDGHRIKVLAEREPARLPWAELGVDIVLEATGRFTSADAARAHLTAGARKVLVSAPSSGADVTLAYGVNTDAYDPAAHTIVSNASCTTNALAPLAAVLDELAGIEHGFMTTVHAYTQEQNLQDGPHRDARRARAAGVNIVPTTTGAAKAIGLVLPGLDGKLSGDSIRVPVPVGSIVELNTTVARDVTREDVLAAYRAAADGPLAGVLEYSDDPLVSSDITGNPASSIFDSALTRVEGRHIKVVAWYDNEWGFSNRVIDTLALLATR

SEQ ID NO: 11862 - protein, 496 aa, Enterococcus faecalis V583
MSKKEINQVVASSYQLYINGEWTTGSGNKMIASYNPSNGEKLAEFVDATNADVDRAVEAAQEAFQTWKDVDVVTRSNLLLKIADLIEENQEHLAMVETLDNGKPLRETQSIDVPASADHFRYFASVIRGEEGSVKEFDKDTLSIVVKEPIGVVGQIIPWNFPLLMGAWKLAPALAAGNTVVIHPSSSTSLSLLELFKIFDQVLPKGVVNLITGRGSDSGNYMLAHPGFDKLAFTGSTEVGYTVAKAAADRLIPATLELGGKSANIIFEDANWERALEGVQLGILFNQGQVCCAGSRVFVQSGIYDQFVEALKEKFEQVNVGFPWEKDVEMGAQINEHQLEEILKYVEIGVKEGATLITGGQRLTENGLDKGAFLAPTLLANGTNAMCVAQEEIFGPVATVIKFETEEEVIRLANDSEYGLGGAVFSQDINVALRVARGVRTGRMWVNTYNQLPAGAPFGGYKKSGIGRETHKSMLDAYTQMKNIYIVTKEEADGLY

SEQ ID NO: 11863 - protein, 245 aa, Triticum aestivum
  unsure (1)..(245): unsure at all Xaa locations
MAAAMLLRRLPAARPPLMAATRAISDSTAPLTIETSMPFTAHIVDPPSRDVATTPAELVAFFHDMSLMRRMEIAADSLYKAKLIRGFCHLYDGQEAVCAGMEAAITRKDSIITAYRDHCIFLSRGGDLVTAFAELMGRQVGCSRGKGGSMHFYKKXTPTFYGGHGIVGAQVPLGLGASPFAPKVQGKEHRSFLLTGEARQTKGPSFFLRGSKNPEPPQLGLENQPFYWGNGGKTGNGRAQKKLLK

SEQ ID NO: 11864 - protein, 293 aa, Ralstonia metallidurans
MKRDSRAGYCASSPELEHWLTRHIAQGFDAESLVLSMLRSGYDAAFARHAVSAAIGHPPAVASAAAPAPVAKAAATPTVTGGNAFRHKDREMPILFRLDSPRILLLQNLLDDAECDAVVALARDRLQRSPVVNPDTGDENLIDARTSMGAMFQVGEHALLQRIEARIAAVTGWPVEHGEGFQVLNYKPGGEYQPHFDFFNPKRPGEARQLRVGGQRVATMVIYLNSPASGGATAFPRIGLEVAPVKGNAVLFSYGLPDGALDERTLHAGLPVEAGEKWIATKWLREHPYRSRG

SEQ ID NO: 11865 - protein, 167 aa, Narcissus pseudonarcissus
TSGTVSCVTSYMVCNSIFNSILRIAGNINYYDTRKQCEGSLCYDFSNMEKFLNKKSVRDSLGVGDIDFVSCSSSVYQAMLTDWMRNLEVGIPALLEDGIKMLIYAGEYDLICNWLGNSRWVHAMEWSGQHDFVSSTEKEFTVAGVKAGVLKTHGPLSFLKVHRRWSH

SEQ ID NO: 11866 - protein, 508 aa, Thermobifida fusca
MINIIIIITIVCVGSHLRVRRGEEQVSLTERPQLFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 11867 - protein, 817 aa, Vibrio vulnificus CMCP6
MKPTQQKQFDKVSFQESVKKHLSATYAHTLENADSRAWYLAMGRALAELTTFDLLATETDKKIVEAKSVNYLSLEFLIGRLTGNNLISMGLYEQITEAMAELGQNLTDLLEEERDPSLGNGGLGRLAACFMDSLAAQEFPTVGYGLHYEYGLFKQSFEAGRQKEAPDAWRGVEGYPWEVARPELAQEIGFYGHVEVINEGGKERRQWVPGMHVKAMPWDLPIVGYESDTVYPLRLWECQAIAPFSLESFNNGNYFEAQHALIDAGNITKVLYPNDNHEKGKTLRLMQQYFHSAASVRDILRRHEAAGHTLASLPNFETIQLNDTHPTIAIPELMRILIDEKGLNWDEAWAISSKTFAYTNHTLLPEALETWSESLIQHLLPRHMEIIYEINHRFLQEVRAKWPGDVAKQQKLSIIQEGFHRMVRMANLCVIGSYAVNGVAALHSELVKRDLFPEFDELYPTRLQNVTNGVTPRRWLKFCNPGLSALISEKIGTDWPAHLEQLEGVAKFADDAKFQKEYMAVKKANKERLANWVKENMNIELDTNAIFDVQIKRLHEYKRQHLNMLHILSLYHRLLNDANFDMAPRVVFFAAKAAPGYHLAKEIIFALNKIAEKINNDPRIGNKLKVVFIPDYRVSMAEIIIPAADVSEQISTAGKEASGTGNMKMALNGALTIGTMDGANVEIREEVGDDNIYIFGLEVDGVEALKAKGYNPFDYYNADPLLKASMDLLLGEEFTPGQPGLLRATFDSLLDGGDPYLCLADFASYVKAHEAMDKQYRDQAGWAKKAILNTALVGKFSSDRSIRDYVNNIWKLEAVHR

SEQ ID NO: 11868 - protein, 363 aa, Buchnera aphidicola (Uroleucon solidaginis)
  unsure (1)..(363): unsure at all Xaa locations
MKTKYRIAVLPGDGIGPEVMREAYKILNILKNYFSLPIETREFNVGGAAIDQDGVALPKTTLLGCENSDAILFGSXXXXXXXXXXXXXXXXXXXLLPLRKHFNLFGNLRPAQLYSELIHLSPLRSDIINNGFNILCIRELTGGIYFGKPAGRLKKNNIEYAFDTEIYYNYEINRIAHLAFQLAKTRNYKVCSIDKSNVLNSSILWREIVQKVSKNYPDVHLSHLYIDNATMQIIKNPNQFDILLCSNLFGDIISDECAMITGSIGMLPSASLNEKKFGLYEPAGGSAPDIEGKNIANPIAQILSVSMLVRYSMNLKTIADKIDQSVISVLKKGYRTADISNNSHYLKTNEMGDVIASALISGE

SEQ ID NO: 11869 - protein, 102 aa, Oryza sativa
  unsure (1)..(102): unsure at all Xaa locations
MAPYVMAASVTTVAPLQGLKFTGGMPVDRRSGNFSFGNVSNGRRIKCMQVWPIEGIKKFETLSYLTPLTVEDLLKQIXYLLRSKWAPWLEFNKVCLDYRENH

SEQ ID NO: 11870 - protein, 478 aa, Bolidomonas pacifica
SDRYESGVIPYAKMGYWDASYSVKETDILALFRVTPQPGVDPVEAAAAVAGESSTATWTVVWTDLLTACERYRAKAYRVDPVPNTTDQYFAFIAYECDLFEEGSLANLTASIIGNVFGFKAVSALRLEDMRIPHSYLKTFQGPATGIIVERERLDKYGRPLLGATVKPKLGLSGKNYGRVVYEGLKGGLDFLKDDENINSQPFMRYKERFLNCMEGINRAAAATGEVKGSYLNITAGTMEEVYERAAYAKSVGTVIVMIDLVMGYTAIQSAAIWARKNDMIIHLHRAGNSTYARQKNHGINFRVICKWMRMAGVDHIHAGTVVGKLEGDPLMIKGFYDVLRMTNLEVNLPFGIFFEMDFASLRKCMPVASGGIHAGQMHQLLYYLGDDVVLQFGGGTIGHPDGIQAGATANRVALEAMVMARNEGQDTFSDEVGPQVLRDAAKTCGPLQTALDLWKDIAFNYTSTDTADFVETTTANV

SEQ ID NO: 11871 - protein, 163 aa, Cucurbita pepo
HWKPTCGVKSMMEEEAIRIGGTNHSHATQDLYESIAAGNFPEWRLYIQTIDYEDQNKYDFEPLDTTITWPEDVVPLQPVGRLVLNKNIDNFFAENEMLAFSMSLVPGIHYSDDKMLQARSFAYADTQRHRLGPNYLQLPVNAPKCPHHNNHHEGFMNFMHRDE

SEQ ID NO: 11872 - protein, 175 aa, Triticum aestivum; identical to SEQ ID NO: 7158

SEQ ID NO: 11873 - protein, 373 aa, Triticum aestivum
  unsure (1)..(373): unsure at all Xaa locations
MAGSVRCSAAARSYSITLLPGDGIGPEVVAVAKDVLSVAGSKEGVELRFQEMLMGGAALDAAGVPLPDETLAAARASDAILLGAIGGYKWDNNEKHLKPETGLLNIRAGLGVFANLRPAXTVLPQLEVAEGVDNMVVRELTGGIYFGKPRGFGTNDKGDVTTDNSEEETGFNTEIYSAAEIDRIARVAFEVARKRGGKLCSVDKANVLEASMLWRKRVTAIASEFPDVELXAMQLIRNPNQFDTIVTNNIFGEIILFVASXLYDEASMTAGSIGMLPAAGVGESGPGLFEPHRCPAPDIAGQDKANPLATILSAAMLLKYGLGVESAAKRIEAAVTETLDNGFRTGDIYSAGTTLVGCKRMGEEVLKALESQK

SEQ ID NO: 11874 - protein, 445 aa, Stenogramme interrupta
  unsure (1)..(445): unsure at all Xaa locations
FRVSPQPGVDPIEASAAVAGESSTATWTVVWTDLLTACDLYRAKAYKVDAVPRTDDQYFAYIAYDIDLFEEGSIANLTAXIIGNVFGFKAVKALRLEDMRLPVAYLKTFQGPATGIVXERERMDKFGRPFLGATVKPKLGLSGKNYGRVVYEGLKGGLDFLKDDENINSQPFMRWKERYLYAMEAVNRSIAASGETKGHYLNVTAATMEEMYERAEFAKQLGSIIIMIDLVIGYTAIQTMGIWARRNDMILHLHRAGNSTYSRQKIHGMNFRVICKWMRMAGVDHIHAGTVVGKLEGDPLMIRGFYNTLLFSYLEVDLPKGIFFEQDWASLRKVTPVASGGIHCGQMHQLLDYLGVDVVLQFGGGTIGHPDGIQAGATANCVALETXVIXXXXXXDYVAEGPQILQDAAKTCGPLQTSLDLWKDITFNYTSTDTADFVETPTANV

SEQ ID NO: 11875 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 11876 - protein, 251 aa, Pseudomonas putida KT2440
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 11877 - protein, 409 aa, Oryza sativa
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAEVAEEYRLVPDTLYLTVNYIDRYLSGNEINRQRLQLLGVACMLIAAKYEEICAPQVEEFCYITDNTYFRDELFIVQDPALHLEFLANYVAELSLLEYNLLSYPPSLVAASAIFLAKFILQPTKHPWAVWLSVDRSMLLLCVIYAADVIDLNMMIQRDS

SEQ ID NO: 11878 - protein, 300 aa, Gloeobacter violaceus
RIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFK

SEQ ID NO: 11879 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 11880 - protein, 424 aa, Synechocystis sp. WH 8501
MRIKRIIASEMLDSRGNPTVEAQVMLEDGTVGSALVPSGASTGEKEAVEMRDGDKSRYKGKGVLKAVENANNHLAPALIGMDVTQQRAIDQTMIDLDGTPNKAKMGANAILAISLAAARTAANYLKMPLYRYLGGTNASLLPVPCMNVINGGSHADNTVDFQEFMIAPHNAPSFAEAIRMGAETFHTLKGLLKDKGLSTGIGDEGGFAPNLKSNEDAIEFIIEAIEAAGYKPGEDISICLDPATSELWKDGKYLFFKSDNSTKTPSEMVALWQDWMNKYPIVSLEDGMGENDWDGWKELTDKIGDKVELVGDDLFCTNPTILAEGIEKGVANSVLIKVNQIGSLTETLDTIELAKKHNYKCFVSHRSGETEDTTIADLVVATSAGQIKTGSGCRGERIAKFNQLLRIERDLGKAARFAGKAAFL

SEQ ID NO: 11881 - protein, 370 aa, Triticum aestivum/Thinopyrum intermedium alien addition line; identical to SEQ ID NO: 10723

SEQ ID NO: 11882 - protein, 314 aa, Microbulbifer degradans 2-40
MGSRMTNKLEQLKQFSSVVADTGDIEAIKRYQPLDATTNPSLLFKAAQLPQYAPLLEKALAESSSIDDACDRLAVAIGCEILKIVPGRVSTEVDARLSFDKNASIDKAHRLIDMYEANGIGKERVLIKLASTWEGIRAAEQLQKEGIDCNLTLLFSFSQAAACADAGVFLISPFVGRILDWYKANTDKKEYLPHEDPGVISVSRIYNYYKQHDYKTVVMGASFRNTGELEELAGCDRLTISPDLLEALAQDTGKLERKLSPENSGEPIAKLIENESQYRFSNNEDAMATHKLAEGIRNFAKDQINLINLLKSKA

SEQ ID NO: 11883 - protein, 119 aa, Glycine max
PPPTPPPPPANRHRSKGGPHLHLVGSSNNPMMECHNQAIRRGKVFVDNETALVEAGELVGAFERGVIKKDEIGGSLVELVRGEKVGRISSEQITVFKSVGSAVVDMLAAQLVYETYTRS

SEQ ID NO: 11884 - protein, 189 aa, Glycine max
  unsure (1)..(189): unsure at all Xaa locations
MDIRLMDLDSPLFNTLHRIMDLTEDAEKNLNAPTRTYVRDAKAMAATPADVKEYPNYYVFVIDMPGLKSGDIKVQVEDDNVLLISGERKREEDKEKEGAKYLRMERRVGKFMRKFTLPENANTDAISAXCQDXVLTCTXNKLPPXSPKAQXXXVXSINFFLPVSFFPFGGQGFFRFLGIFLKKKKPGPF

SEQ ID NO: 11885 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYTKSASDNIIIQYGGSVNSNNVKELMNEPNIDGALIGGASLKAESFLSIINNVL

SEQ ID NO: 11886 - protein, 454 aa, Iridaea tuberculosa
VKDTDVLALFRVSPQPGVDPVEASAAVAGESSTATWTVVWTDLLTACDLYRAKAYKVDIVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEEIYERAEFAKELGSIIVMIDLVIGYTAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGATANRVALESMVIARNEGRDYVTEGPQILQDAARTCGPLQTALDLWKDISFNYTSTDTADFVETPTANV

SEQ ID NO: 11887 - protein, 238 aa, Candida albicans
MDLKLPPTNPTNPQQAKTFMKSIEEDEKNKAEDLDIIKKEDIDEPKQEDTTDGNGGGGIGIVPTLQNIVATVNLDCRLDLKTIALHARNAEYNPKRFAAVIMRIRDPKTTALIFASGKMVVTGAKSEDDSKLASRKYARIIQKLGFNAKFCDFKIQNIVGSTDVKFAIRLEGLAFAHGTFSSYEPELFPGLIYRMVKPKIVLLIFVSGKIVLTGAKKREEIYDAFESIYPVLNEFRKN

SEQ ID NO: 11888 - protein, 259 aa, Glycine max
MSSAAGAPDRRASPPRVAAGAPTRPPLKRHLAFITKPPFAPPDEYHSFSSIGSRRAADEAVVVRSPYIMKRKSGMNDSEGESLAQKWSNSPGYTNVSNVTNNSPFKTPVSAKGGRTQKAKASKGRSCPPTPISNAGSPSPLTPASSCRYDSSLGLLTKKFINLVKHAEGGILDLNKAAETLEVQKRRIYDITNVLEGIGLIEKKLKNRIHWKGIESATSGDVDGDISLLKAEVEKLSLEEQGIDDQIREMQERLRNLSE

SEQ ID NO: 11889 - protein, 576 aa, Oenococcus oeni MCW
  unsure (1)..(576): unsure at all Xaa locations
MPWNEKDYPVSMKNMKKVVRDKAIEIANALKEEKYSDQRAISXXXXXXXXXXXXXXXXXXXXXXXXXXXXXXXXXXXXXXXXXXXXXXXXXXXXXXXXXXXXXXXXXXXXXXXXXXXXKLFDDVAVFNRTISSVDNLAEIVDQAIRSAYENKGVAVLTIPDDIPDQELKTIYHSSAKAFSLAKPSINEEQINKASELIKNSQKPIALIGLGAKESGEEVTSFLEKNNIPFVQTLPAKGTISDDHPNSLGNVGKLGTKPAYEAMKNADLLILLGSNYPYLPYLPNKGQAKCIQVDLKAENLGKRYSVTTAIQADVYDVVHALNKKGVLRDNKSFLQACQKNMDNWNKWMQEKRELDTTPISPESMVAYIDQTAPDDLVYSIDVGTSTSWAARFLHVKRNQKFAISAWLGTMGCGLPGAIAGQIVFPKRRVLSLIGDGAFSMVMQDFVTAVKYKLPIIFVIINNQKLAFIEYEQQSAGQLNYEINLADIDFGKFAQAAGGIGITVKSNDKFKEALDQAYQTKDKPVLINAYVEDNAPLPGKIVLDEAKGFAKFGQEYLENYWKIPELPPFKDILRQFF

SEQ ID NO: 11890 - protein, 336 aa, Aspergillus niger
MAPKVGINGFGRIGRIVFRNAINHGEVDVVAVNDPFIETHYAAYMLKYDSTHGQFKGTIETYEEGLIVNGKKIRFFAERDPAAIPWGTTGADYIVESTGVFTTQEKAAAHLKGGAKKVVISAPSADAPMFVMGVNNTSYTKDINVLSNASCTTNCLAPLAKVINDKFGIVEGLMTTVHSYTATQKVVDAPSSKDWRGGRTAAQNIIPSSTGAAKAVGKVIPTLNGKLTGMAMRVPTSNVSVVDLTCRLEKATSYDEIKKALKDASENELKGILGYTEDDIVSSDLNGDDHSSIFDAKAGIALNSNFVKLVSWYDNEWGYSRRVVDLIAYISKVDAQ

SEQ ID NO: 11891 - protein, 217 aa, Glycine max
  unsure (1)..(217): unsure at all Xaa locations
TXXPSGIVPTLQNMXXXVNLDCRWALHSXNFHARFAVLFPTRLAARIIRIRGPPATALVFASRNMVGSGAWRVPQSAGAACMFPWCFLKLGSPAVSRAFLPQDAAGSCVAXFPLRLEGPAWSHGACSGFHPLRFPGPRARWVQPKPALLVFLAGAGALAGPRGSGDSYSAVEGFYPVRSEFRTALRGAPRPCVLELAWCGLVAGRPEIEISVIWIEF

SEQ ID NO: 11892 - protein, 337 aa, Streptococcus mutans UA159
MVVKVGINGFGRIGRLAFRRIQNVEGVEVTRINDLTDPNMLAHLLKYDSTQGRFDGNVEVKEGGFEVNGKFVKVSAERDPEQIDWAADGVEIVLEATGFFASKAAAEKHLHANGGAKKVVITAPGGNDIKTIVFNTNHDVLDGTETVISGASCTTNCLAPMAKALHDNFSIKEGLMTTIHAYTGDQMVLDGPHRKGDLRRARAAAANIVPNSTGAAKAIGLVIPELNGKLDGAAQRVPVPTGSVTELVAVLDKKVTVDEVNAAMKAAANESYGYTEDPIVSSDIVGMSFGSLFDATQTKVLDVDGKQLVKVVSWYDNEMSYTSQLVRTLEYFAKIAK

SEQ ID NO: 11893 - protein, 393 aa, Oryza sativa (japonica cultivar-group)
MARSWLITGRGVAKKIRNAPHCSSRPISELGAEAQMECPNCKHVIDNSDVAIQWPGLPAGVKFDPSDLELLEHLEQKIGLGGSKPHTFIDEFIPTIDNDEGICYSHPENLPGMKKDGTSGHFFHRVSNAYGCGQRKRRKISNCDHVVSVEHVRWHKTGKSKAIVEKGVTKGWKKIMVLYKSSQRGAKPDKANWVMHQYHLGAEEDEKDGELVVSKISYQLHGKQIDKSETGNADEESDAFAARVGPKTPKSNTPQPCRLKNSPCETENYDPILEDQDEEESNIPIVSLKDDAGNPAWCAGETQAAREAVQACPNLDESLRCHEVLDSFYHETLLPSDRPILSQGGNEILDRNLNAVYGLPDLYNVDLGTPPDFQLADLQFGSQESIGNWLDSI

SEQ ID NO: 11894 - protein, 134 aa, Staphylococcus aureus
HETDKEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 11895 - protein, 446 aa, Nicotiana tabacum
MASRNVLQQQNIGEAVPGALKQKNMAAAAQGRNRKALGDIGNNMVTVRGVEGKPLPQRPITRGFCAQLLANAQAAAENQKKSMVVNGDAPIVAKGVLPVKGAAKKPVQKKAAVKPKPDVIEISPDTEEQVKENKQKKKAGDDSSVKKATLTSTLTARSKAACGLSHKPKVQIVDIDAADVNNELAVVEYVEDIYNFYKIAENESRIHDYMDSQPEITARMRAILIDWLIEVHHKFELSQETLYLTINIVDRYLAVTTTSRRELQLVGMSAMLIASKYEEIWAPEVNDFVCISDKAYSHEQVLGMEKRILGQLEWYLTVPTPYVFLVRYIKAAVSNAQMENMVYFLAELGLMNYATNIYCPSMIAASAVYVAQHTLNCTPFWNDTLKLHTGFSESQLLGCAKLLVSYHMEAPEHKLKVIYKKYSKPERGAVALQPPAKSLLAASSYE

SEQ ID NO: 11896 - protein, 217 aa, Thermosynechococcus elongatus BP-1
MTSAASSVARSDLAELRRLKSLLPPELQSWVMIEPASGVNPPLITCEEIGKDEVEIQIDLARWDQLAKDQRNLLFWHEVARIQNDTIPRDGWEMAALAIGLGGAVGELWVQDGLLLLLALGLCGFSGWRLYQRNNGEKVLKEAIAADERAIALATRFGYELPNAYKSLGSALKLLIEQAPNRRQRKHYELRLQALKKSAAKAKARMQAMQNDTPAGS

SEQ ID NO: 11897 - protein, 261 aa, Capsicum annuum
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 11898 - protein, 588 aa, Ralstonia sp. EDS2
GPQAMTPSEAFVETMVANGVTEMFGIMGSAFMDAMDIFAPAGIRLIPVVHEQGAAHMAYGYARASGRHGVTIGQNGPGISNCVTAIAAAYWAHSPVVIITPETGTMGMGLGGFQEANQLPMFQEFTKYQGHVNNPKRMAEYTARCFDRAMSECGPTQLNIPRDYFYGEIECEIPKPMRVERGAGGEQSLQAAADLLSTAKFPVILAGGGVVMGNAVEECKALAERLGAPVVTGYLRNDAFPASHPLWAGPLGYQGSKAAMKLIAQADVVIALGSRMGPFGTLPQHGMDYWPKEAKIIQVEADHTNLGLVKKISVGIHGDAKATAAELSKRLAGKTLACDATKDARAQTIKAEKDAWEKELTEWTHERDPYSLDMIEEAKKEGGKFLHPRQVLRELEKAMPPRVMVSTDIGNINSVANSYLRFEEPRSFFAPMSFGNCGYALPTIIGAKCASPDRPAIAYAGDGAWAMSMVEIMTAVRHNIPVTAVVFHNRQWGAEKKNQVDFFSRRLVAGELENPSFAEIARTMGAEGITVDTLEDVGPALKKAIDMQMNEGKTCVIEIMCTRELGDPFRRDALSKPVRLLDKYKDYV

SEQ ID NO: 11899 - protein, 312 aa, Methanothermobacter thermautotrophicus
MLFDAVGLGALNMDQLHMVERIAGPDEEVFVRSILESCGGSAANTIIGLARLGLRTAFIGKVAGDREGSILRENLKGGGVADYVAVSDEGRSGRVMGFVDPQGNRALYVDPGVNDTLSMDEVREEALKTRLLHLTSFAGSGIRVQREVLGVIDDSVTVSLDPGHLYAERGASELEGILERTDILLVNRRELEILTGSPDPAMASAELGVDVVVMKMGSEGVRAFDGSEVMVEALETSCRDTTGAGDAFNAGFLYAWLSGHGLEVSCLFGNYMASRCIEGYGATSSLPGREALEVLEGYLRDTYQEKRGDSGK

SEQ ID NO: 11900 - protein, 810 aa, Oceanobacillus iheyensis HTE831
MKLRKKKLVNRISQELAHQKGLTIEGASSRDIYEVLASIINESMEDNWKATQEGYAYGKYKQVYYLSMEFLIGRLMESNLLNLGLLDEAKEAIRELGFNEEEVFSQEHDAGLGNGGLGRLAACFLDSLASLQYPGHGYGIRYRYGLFEQRIIHGNQVELPDYWLTYPYPWEYRKEEDAVVIHFEGNVHIHEDQDGNLIFSYDQTNKVKAIPYDIPISGYQNGTVNTLRLWSAEAIDNIGGSLEENTTYYKELAHQHTIEQISGFLYPDDSSEEGKSLRLKQQYFLVSASIQSIVQQYKQTHKISIDRLHEKVSIQINDTHPSLGIPELMRILLDEEGLSWDNAWKVTTNTFAYTNHTTLSEALEKWPVATIKQLMPRIYMIIEEINERFCQELWLDYKHLRNQIADMAIIAHDTVHMAHLAIVGSYRVNGVARIHTEILKTQEMKYFYQRFPDKFTNKTNGITHRRWLLQVNPELSTLVTDVIGSQWIKRPKKLISLLKYAEDSSVLEKLKEVKLTNKQKLASVIQQRTGIMVDPHSIFDVHIKRLHEYKRQLLNVFHIIYLYNELKDNPQQDVIPRTFIFAAKAAPSYYMAKEVIKLIHTVASIVNHDPDIKGKLKVIFLENYQVSLAEQIIPAADISQQISTASKEASGTGNMKLMMNGAITLGTLDGANIEIRDVVGNDNMFIFGLTAEEVIEYYRNGSYSARALYDQDERIRRILDQLNDGDFGIHQMEFKDIYYHILSHNDPYFVLQDFEPYLEAHELVERAYRNKNKWLSMSLTNIAHSGKFSSDQTIQSYATDIWKLKQVPIK

SEQ ID NO: 11901 - protein, 135 aa, Triticum aestivum
AIGVSATKGEAWRNLWTIGLHKIFAAVAMGIALLRMIPKRPFLMTVLYSLAFAVSSPVGVGIGIAIDATAEGPAADWTYAISMGIATGIFVYVAINHLMARGYRPQQPNYFDKPIFKFLGVLTGVAVMAVVMIWD

SEQ ID NO: 11902 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEAAAAVALSVSGELQRVHFDNSSFSPLFSLLQKERVKKIGEMIESDGSDLCSQTPNGVLEVSACCFSFKTHDSSSSYTHLS

SEQ ID NO: 11903 - protein, 443 aa, Callophycus africanus
VTPQPGVDPIKASAAVAGESSTATWTVVWTDLLTACDLYRAKAYKVDAVPNSTDQFFAFISYDIDLFEEGSIANLTASIIGNVFGFKAVKALRLEDMRIPVAYLKTFQGPATGIISERERMDKFGRPFLGATVKPKLGLSGKNYGRVVYEGLKGGLDFLKDDENINSQPFMRWKERYLYAMEGVNRSIAATGEVKGHYLNVTAATMEQMYERAEFGKQLGSIIIMIDLVIGYSAIQTMGIWARKNDMILHLHRAGNSTYSRQKIHGMNFRVICKWMRMAGVDHIHAGTVVGKLEGDPLMIRGFYNTLLLPHLDVNLPQGIFFEQDWASLRKVTPVASGGIHCGQMHQLLDYLGIDVVLQFGGGTIGHPDGIQAGATANRVALEAMVIARNEGRNYVAEGPQILQDAAKTCGPLQTALDLWKDITFNYTSTDTADFVETPTANV

SEQ ID NO: 11904 - protein, 415 aa, Polysiphonia japonica
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYRRVVYEGLRGGLDFLKDDENINSQPFMRWKERFLYSMEAVNRSIASTGEVKGPYMNITAATMEEMYERAEFAKQIGTIIVMIDLVIGYTAIQSMAVWARKNDMILHLHRAGNSTYSRQKIHGMNFRVICKWMRMAGVDHIHAGTVVGKLEGDPPMIRGFYNTLLETHLDINLPQGIFFQQDWASLRKVAPVASGGIHCGQMHQLLDYLGNDVVLQFGGGTIGHPDGIQAGATANRVALESMVIARNEGRDYVAEGPQILRDAAKTCGPLQTALDLWKDITF

SEQ ID NO: 11905 - protein, 453 aa, Heterosiphonia plumosa
KETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGLIVERERMDKFGKPFLGATVKPKLGLSGKNYGRVVYEGLKGGLDFLKDDENINSQPFMRWKERFLYSMEAVNRSIAATGEVKGHYMNVTASTMEDMYERAEFAKQLGTVIIMIDLVIGYTAIQTMAIWSRKNDLILHLHRAGNSTYSRQKSHGMNFRVICKWMRMAGVDHIHAGTVVGKLEGDPVMIKGFYDTLLLSHLDINLPQGLFFQQDWASLRKVTPVASGGIHCGQMHQLVDYLGNDVVLQFGGGTIGHPDGIQAGATANRVALEAMIIARNEGRSYVEEGPQILRDAAKTCGPLQTALDLWKDITFNYTSTDTADFVETPTANV

SEQ ID NO: 11906 - protein, 317 aa, Oryza sativa
  unsure (1)..(317): unsure at all Xaa locations
MAFHGHLPHEMTMQALGADDAAVAAAAAAXTTSDSSASPSGAAAAAAAXGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTKEEDKARLVQETGLQLKQINNWFINQRKRNWHS

SEQ ID NO: 11907 - protein, 354 aa, Bacillus anthracis str. A2012
MEKRIVCLAGDGVGPEVMESAKEVLHMVERLYGHHFHLQDEHFGGVAIDLTGQPLPQRTLAACLASDAVLLGAVGGPRWDGAKERPEKGLLALRKGLGVFANVRPVTVESATAHLSPLKKADEIDFVVVRELTGGIYFSYPKERTDEVATDTLTYHRHEIERIVSCAFQLASKRKKKVTSIDKANVLESSKLWRIVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGTETTTSFTKAVMQEMEEQALVGRGR

SEQ ID NO: 11908 - protein, 308 aa, ASPERGILLUS NIDULANS FGSC A4
MTRTHPSSFQQLEKLGEGTYATVYKGRNCQTGEMVALKEIHLDSEEGTPSTAIREISLMKELHHDNILSLYDVVHTENKLMLVFEYMDQDLKKYMDTHGNHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFPGTTNEDQLQKIFRVMGTPSERTWPGVSQFPEYKSDFPVYPPQDLRQVVPRIDPYGLDLLRCMLRLQPDLRISAVDALRHPWFNDPVSDLPIDHGMEALT

SEQ ID NO: 11909 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYHNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 11910 - protein, 314 aa, Mesorhizobium loti
VMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 11911 - protein, 314 aa, Cyanidium sp. 3-8 CR
NGFGRIGRLVLRAALESKLIRVTAINDPFIGSDPAYVAYLLTHDTAQGRFFGEIRVDDDCIMIDSVPIRCFAVHDPAEIPWQQAGVEYVVEASGKFVTREGAEKHLLAGARKVIVSAPAKDVPMFVVGVNHSQYHPSMDIVSNASCTTNCLAPLAKILDEHFGIEQGLMSTIHAVTGTQRTVDGPSSKDWRRGRSALGNVIPTSTGAARAVGKVYPKLEGKITGLAYRVPLAVVSIVDFTVVLQKPVTLSQLKEVMRAASEHPTYRGIVGYTEDAVVATDMAHSAFSTVFDAEASIVLSPTFVKIVAWYDNEWG

SEQ ID NO: 11912 - protein, 403 aa, Corynebacterium glutamicum ATCC 13032
MNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 11913 - protein, 484 aa, Aspergillus niger
LSAASWRTQSIYFLLTDRFGRTDNSTTATCNTGNEIYCGGSWQGIIDHLDYIEGMGFTAIWISPITEQLPQDTADGEAYHGYWQQKIYDVNSNFGTADNLKSLSDALHARGMYLMVDVVPDHMGYAGNGNDVDYSVFDPFDSSSYFHPYCLITDWDNLTMVEDCWEGDTIVSLPDLDTTETAVRTIWYDWVADLVSNYSVDGLRIDSVLEVQPDFFPGYNKASGVYCVGEIDNGNPASDCPYQKVLDGVLNYPIYWQLLYAFESSSGSISNLYNMIKSVASDCSDPTLLGNFIENHDNPRFAKYTSDYSQAKNVLSYIFLSDGIPIVYAGEEQHYAGGKVPYNREATWLSGYDTSAELYTWIATTNAIRKLAIAADSAYITYANDAFYTDSNTIAMAKGTSGSQVITVLSNKGSSGSSYTLTLSGSGYTSGTKLIEAYTCTSVTVDSSGDIPVPMASGLPRVLLPASVVDSSSLCGGSGRLYVE

SEQ ID NO: 11914 - protein, 706 aa, Mycobacterium avium
MATDHTSDAPDPKQRDLESARFRRDTGYLTTQQGVRVDHTDDALTVGERGPTLLEDFHAREKITHFDHERIPERVVHARGAGAYGYFEPYDDRLAQYTAAKFLTSPGTRTPVFVRFSTVAGSRGSADTVRDVRGFATKFYTEQGNYDLVGNNFPVFFIQDGIKFPVLVHAVKPEPHNEIPQAQSAHDTLWDFVSLQPETLHAIMWLMSDRALPRSYRMMQGFGVHTFRLVNARGRGTFVKFHWKPRLGVHSLIWDECQKIAGKDPDYNRRDLWEAIESGQYPEWELGVQLVAEDDEFSFDFDLLDATKIIPEEQVPVLPVGKMVLNRNPDNFFAETEQVAFHTANVVPGIDFTNDPLLQFRNFSYLDTQLIRLGGPNFAQLPVNRPVAQVRTNQHDGYAQHAIPQGRSSYFKNSIGGGCPALADEDVFRHYTQRVDGQTIGKRAEAFQNHYGQARMFFKSMSPVEAEHIVAAFAFELGKVEMPEIRSAVVAQLARVDDQLAAQVAAKLGLPEPPEEQVDESAPVSPALSQVTDGGDTIASRRIAVLAADGVDVVGTQRFTELMEQRGAVVEVLAPVAGGTLAGGSGGELRVDRSFTTMASVLYDAVVVACGPRSVSTLSDDGYAVHFVTEAYKHLKPIGAYGAGVDLLRKAGIDNRLAEDTDVLNDQAVVTTKAAADELPERFAEEFAAALAQHRCWQRRTDAVPA

SEQ ID NO: 11915 - protein, 525 aa, Glycine max
MDGYDGTVRLGAINLKHDRAADFDSATAAPDVSVSSPVTRQKAAAAKQFIENHYKNYLQGLQDRKDRRRALQRKVQESQVSAEEQEEMMRNLERRETEYMRLQRRKIGIDDFEQLTVIGKGAFGEVRLCRAKDTGEIFAMKKLKKSEMLSRGQVEHVRSERNLLAEVDSRCIVKLHYSFQDSDFLYLIMEYLPGGDIMTLLMREDILSEDVARFYIAESILAIHSIHQHNYVHRDIKPDNLILDKNGHLKLSDFGLCKPLDDKYSSILLENDDLTSQESTSETEGYSVSPWLMPKEQLQQWKRNRRALAYSTVGTLDYMAPEVLLKKGYGIECDWWSLGAIMYEMLIGYPPFCSDDPRMACRKIVNWKTCLKFPDEPKISAEAKDLICRLLCDVDSRLGTRGIEEIKAHPWFKGVQWDMLYESEAAYKPTVTGDLDTQNFEKFPEVDGPPSVTATVGPWRKMLTSKDNNFIGYTFKKSDILKSLESSDADIRVNGSSKTPSLITLLGRIDLQDTIIPESEQKPEA

SEQ ID NO: 11916 - protein, 341 aa, Lactobacillus gasseri
MTIMQKKILLLSTGGTIASVVSDAGLVPKESGEQLINMLGELPYDITVEDILQLDSSNIQPEEWKLIAEKIFENRNKYDGIVVSHGTDTMAYTASMLAFMLQNINIPVVLTGSQVPINVVLSDAPDNLRLAFAAAATCCPNIYLAFDRKVMLGCRSVKVRTINFDAFESVNVPPVAKVTSDGLVFSEQNLSKNTRECTLNTEINPHVSLVKLFPGFDPKLLFAMVKSGCKGIVIEAYGLGGMNYIRRNMVGAVGELIRQGIPVIASSQCLYERSDLTKYEVGREALLEGAISARDMTSESAITKLMWGLGQGWDVHQIAEFFNTDVVGEVTIEKDDTLRVD

SEQ ID NO: 11917 - protein, 558 aa, Thermoanaerobacter tengcongensis
MQHLRRYREIIFVFIKYGFGAIIDNIGILKHINVRRKILKQTNDENIAKLSRGERLRLALEELGPTFIKMGQILSTRSDILPKDIIKELEKLQDKAPAFSFDEVKSVIQNEFGESLEEAYAEFEPTPLAAASIAQVHKALLWSGKTVVVKVQRPGIEKIIAQDMRILEDIAKFVDNHTKYGKIYNFTKMVEDFKKRLEEELDFRIEGENAEKFKKNFLKDKKVKIPSIIWTHTTRRVLTMEYIGGIPLNDFNAIDEAGLDRGAIARNLAKSVLNQILRDGFFHGDPHPGNIMVLEDGTIAFLDFGMVGSLSPERKRQFSKMLLGIVYKNSRMIIESIIDLNAVTLNVNMKKLEKDINNLRDRYVEIPLEKLKVGEVLNGIFDLVFSYNIVIPNEFNMLAKSLITLEGIVEKLDPKISVLEVAKPIAKQLIPKMFSTQHMKEEIINATMDYSRLIKELPSFLLNFLRKTEEENYAIELKIRDLENLEKRVDKVFNRLSTSIILLALSIVIAGILIGSGMSANAGAEMYKLNGIILKIGLAIAFVIVLGLAISIFRSGRL

SEQ ID NO: 11918 - protein, 319 aa, Listeria monocytogenes EGD-e
MQKEKAPIGLYFLLIAVMASWGFNVTMTKVLVSYFPTVTMTSFRIFTAAITVIIILFITKKLRLPTKQEFGLILLASIFNIVIHHFFLSNGLKLTTGTNAGLILGSAPIVVAIFSVIFLRERIGAWRALGFLAGIFGVSLVVLSNGTGISGISLGDIDIFIAMASQAFSFIIIKKLAGSMDTGLMTGYMLFLGSVMLFGLSRFMEPDGMSELVTVHSWKLWLLFVVSAVVATAFGNFVYNYAVGKIGPSRSAIFMNFNPLFSLIGALLFLGEAIKIPQLVGFGFIIIGVLLGSGALMDLIYERKKTKVRDPEKLLEKEV

SEQ ID NO: 11919 - protein, 100 aa, Zea mays
  unsure (1)..(100): unsure at all Xaa locations
DLVQWVASSDLARREQNGPEDMWTGRWLNXAGKGKNRXDNAPRMYNYKGASPDSCFRHGFVPDTIAVHMLKDDARWAXTLAYFNATSGLYRQPLPAASSP

SEQ ID NO: 11920 - protein, 362 aa, Oryza sativa; identical to SEQ ID NO: 9501

SEQ ID NO: 11921 - protein, 554 aa, Oryza sativa
MCISESNIALTPISLQNSYDTLWHATCSLQRNIHRYHSTSSIVFSIQREFIRSVAGIKEEEGIVLKCLEYWEWNCHDNVYRLATACAVPSVCDHDADGAGARSQKLDGDGNGRHRPPPATCPGSTLTPSRPRHIPEHSVTASSRIASPSRMAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIEIVEKYSNSNIEIHTFNQSQYPRIVTEDFLPLPSKGKTGKDGWYPPGHGDVFPSLNNSGKLDTLLAQVTPKTLADVKGGTLISYEGRVQLLEIAQVPDEHVNEFKSIEKFKIFNTNNLWVNLKAIKRLVEAEALKMEIIPNPKVCHLWFCVYLPRSILSIGIYQSSWYSQEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLK

SEQ ID NO: 11922 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 11923 - protein, 503 aa, Avicennia marina
MSTMAIRMPTRQLFIDGEWREPVQRKRILIINPANEQTIGDIPAATAEDVDIAVEAARKAFFRNSGKDWSSTTGAHRAKYLRAIAAKIKDRKAELVKLEAIDSGKPLVEASLDMDDVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIAATFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAIDLANDTHYGLAAAVISKDLDRCERMAKAFQVGAVWVNCSQPCFYQAPWGGKKRSGFGRELGERGLDIYLNVKQVTQYVSSEPWDWYKSP

SEQ ID NO: 11924 - protein, 235 aa, Brassica rapa
SCERAPAAFFCKADAASLCTACDSQIHSANPLARRHQRVPILPISGSMVTNHSSETTEAEDIVVVGQEEEDEAEAASWLLPTSVKNCGDNNNNDNNSQDNRFSVGEEYLDLVDYSKYQQDYNVPQRRSYVADGVVPLQVEVSKSLSHMHHEQHNFQFGFTNVSSEASPIHMVSLVPESTLSETTVSNPRSPKAATEELPEAPVQMLSPMERKARVMRYREKKKTRKFEKTIRYAS

SEQ ID NO: 11925 - protein, 148 aa, Zea mays
FYTEEGNYDLVGNNMPVFFIQDAIKLPDFVHAVKPEAPNEMPTGACAHDTFWDFVSLVPETTHTELWLMSDRALPASYRAMDSLGVHTYRFVNAAGAEHFLDLWMAIERGGYQELEHGEQLIDPSDASKFDFDMLDPSKLVPPELVPV

SEQ ID NO: 11926 - protein, 153 aa, ASPERGILLUS NIDULANS FGSC A4
MAPPPVNKSEDEWRAVLSPGKQACPAHSKSPPWAMAAGCSIEMESEYDSHYPSKGVYTCAGCHAPLYKASHKFKSGCGWPAYFDSIPGAVQRHVDNSFGMERTEITCTNCGGHLGHVFKGEGYPTPTDERHCVNSISLKFTENEEGEGAKAKA

SEQ ID NO: 11927 - protein, 445 aa, Gymnogongrus crenulatus
  unsure (1)..(445): unsure at all Xaa locations
FRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEQMYERAEFAKQLGSIIIMIDLVIGYSAIQTIGIWARANDMILHLHRAGNSTYSRQKIHGMNFRVICKWMRMAGVDHIHAGTVVGKLEGDPLMIRGFYNTLLLPXLKVNLPQGIFFEQDWASLRKVTPVASGGIHCGQMHQLLDYLGVDVVLQFGGGTIGHPDGIQAGATANRVALESMVIARNEXXXXXAEGPQIXQDAAKTCGPLQTALDLWKDITFNYTSTDTADFVETPTANV

SEQ ID NO: 11928 - protein, 257 aa, Pseudomonas aeruginosa UCBPP-PA14
MPKEMLPVVNKPLIQYAVEEALEAGLSEIGIVTGRGKRSLEDHFDISYELEHQIRNTDKEKYLVGIRRLIDECTFAYTRQVEMKGLGHAILTGRPLIGDEPFAVVLADDLCLNLEGDSVLKQMVKLYNQFRCSIVAIQEVPPEETNKYGVIAGEMIRDDIFRVNTMVEKPKPEEAPSNLAIIGRYILTPDIFDLIEQTEPGKGGEIQITDALMKQAQDGCVLAYKFKGKRFDCGSAEGYIEATNFCYENLYKTGKAH

SEQ ID NO: 11929 - protein, 550 aa, Oryza sativa
MLARKFASNCNFRVAAAANHSRPMLRFLTVAIRSPPDRWSGRSPSAPQLAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAEVQSFLALLQNECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLQHHTGFTESQLLDSAKLLVTSHSTAPESKLRVVYKKYSSEQLGGVALRSPAVELCK

SEQ ID NO: 11930 - protein, 337 aa, Zea mays; identical to SEQ ID NO: 8670

SEQ ID NO: 11931 - protein, 488 aa, Ahnfeltiopsis glomerata
MSNSVEERTRIKNERYESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYDTLLLPFLKVNLPQGIFFEQDWASLRKVTPVASGGIHCGQMHQLLDYLGDDVVLQFGGGTIGHPDGIQAGATANRVALESMVIARNEGRDYVAEGPQILQDAAKTCGPLQTALDLWKDITFNYTSTDTADFVETPTANV

SEQ ID NO: 11932 - protein, 509 aa, Novosphingobium aromaticivorans
MHDGSRVMASSEGQLSKLGEAARTFLATRPGLLIAGRNTPAASGARRDVLDPSTGLVVTDVAEGGAADVDAAVAAARATFQSAEWRDMRPLARERLLHRLADLIERDADILAELEVIDTGKILPMARHGDLVIALDSLRYMAGWTTKIEGTTIDPSFSYIPPIRFSARTVRQPVGVVGQIIPWNFPLVMAIWKIAPALAAGCTVVLKPAEDTPLTALYLGRLIAEAGFPAGAVNIVTGGREVGMAIVEHPGIDKIAFTGSTAAGQDIQRRAAATMKRLSLELGGKSPVVILEDCPVPMAVEGAAGAIFFNHGQVCTAGSRLLVHRSIYEDVVQGLAHAANGMVLGEGMDPAGQMGPLISARQRDRVAGYVQGALDQGARLLAGGEAPDRDGFFYRPTVLADGTPSMTIFQEEVFGPVVIAMPFDTEEEALALANDSCFALGASVWTQNLAAANRFAGALRSGNVWINAHNILDPAVPFGGWKMSGYGRELGHSAVELYTEAKSITMPLL

SEQ ID NO: 11933 - protein, 500 aa, Oryza sativa; identical to SEQ ID NO: 1605

SEQ ID NO: 11934 - protein, 356 aa, Burkholderia fungorum
MTTPQDIIRRDVLAMTSYPVPDATGYIKLDAMENPFPLPPVLAAHLGEHLAGVALNRYPAPRPDALIEKIKRVMQVPPGCDVLLGNGSDEIISMVSVACAQPGAKVLAPVPGFVMYQMSAKLANLEFVGVPLKADFTLDTEAMLAAIAEHQPAIIYLAYPNNPTGTLFDDADMERIIAAASKSLVVIDEAYQPFAQQSWLPRADAFDNVVVMRTVSKLGLAGIRLGYLVGKPGWLTEFDKVRPPYNTNVLTQAAADFLLDHVDVLDSQAAQLREERTKLAHAIAQLPGAEVFPSAGNFLLVRVPDASVLFETLLAARVLIKNVSKMHPLLANCVRLTVGSPEENAQLLAALKLVLH

SEQ ID NO: 11935 - protein, 758 aa, Arabidopsis thaliana
MWRLRTGPKAGEDTHLFTTNNYAGRQIWEFDANAGSPQEIAEVEDARHKFSDNTSRFKTTADLLWRMQFLREKKFEQKIPRVIIEDARKIKYEDAKTALKRGLLYFTALQADDGHWPAENSGPNFYTPPFLICLYITGHLEKIFTPEHVKELLRHIYNMQNEDGGWGLHVESHSVMFCTVINYVCLRIVGEEVGHDDQRNGCAKAHKWIMDHGGATYTPLIGKALLSVLGVYDWSGCNPIPPEFWLLPSSFPVNGGTLWIYLRDTFMGLSYLYGKKFVAPPTPLILQLREELYPEPYAKINWTQTRNRCGKEDLYYPRSFLQDLFWKSVHMFSESILDRWPLNKLIRQRALQSTMALIHYHDESTRYITGGCLPKAFHMLACWIEDPKSDYFKKHLARVREYIWIGEDGLKIQSFGSQLWDTALSLHALLDGIDDHDVDDEIKTTLVKGYDYLKKSQITENPRGDHFKMFRHKTKGGWTFSDQDQGWPVSDCTAESLECCLFFESMPSELIGKKMDVEKLYDAVDYLLYLQSDNGGIAAWQPVEGKAWLELLNIMIFRYVECTGSAIAALTQFNKQFPGYKNVEVKRFITKAAKYIEDMQTVDGSWYGNWGVCFIYGTFFAVRGLVAAGKTYSNCEAIRKAVRFLLDTQNPEGGWGESFLSCPSKKYTPLKGNSTNVVQTAQALMVLIMGDQMERDPLPVHRAAQVLINSQLDNGDFPQQEIMGTFMRTVMLHFPTYRNTFSLWALTHYTHALRRLLP

SEQ ID NO: 11936 - protein, 525 aa, Hordeum vulgare subsp. vulgare
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAGQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGNHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDAIAPTGV

SEQ ID NO: 11937 - protein, 336 aa, GIBBERELLA ZEAE PH-1
MFAASRIQRRAFSATARDLSKVTVLGAAGGIGQPLSLLLKMNPRVTDLALYDIRGGPGVAADISHVNTKSSVKGYEPNAAGLKEALSGAEVVLIPAGVPRKPGMTRDDLFNTNASIVRDLAKAAAEAAPKAKLLIISNPVNSTVPIVKEVYKAAGVYNPKTLFGVTTLDVVRASRFVSEIKGTDPKDENITVVGGHSGVTIVPLFSQSNHPDLSSNAELVKRVQFGGDEVVKAKDGAGSATLSMAMAGARMADSVLRAVQGEKGVKEPAFVESPLYKDQGIEFFSSQVELGPEGVEKIHPLGKLDANEEKLVDAALVDLKKNIEKGVAFVASNPPK

SEQ ID NO: 11938 - protein, 479 aa, Botryotinia fuckeliana
MAQTNGVLQEPAITTMNGAPVLKPASTQRIGNQLRATLLLQDINLLELIQHITHERIPERVVHARGTSAHGYFEVTDDISDVTSAAFLNRVGKQTDIFCRFSTVAGRAESAETVRDTRGFAFKMFTEEGNLDWLFLSTPVFPIRDGAKFPSFTHATKKNPRSGLPDHKAFWDYFTHNQEGIHFLMFLFSDRATPVDFQHADIFSINTYKFTKSDGSFTYVKIHLKTNQGVKNFTQDEANQKAGVDPDFQTRSLYEDIENQKYPTWDVFAQIIDPVKAENYHINIFDATKTFPFSEFPLRKFGKITLNRNVDNFFAEQEQSAFSPTNLVPGWALTPDPIIQTRALAYADTQRYRLGANFVQLPVNAPYKKPFTPLIRDGAATVNGNLGGTPNYFPSSFYNVGAATQYAQPDEEQFQGTVVNFESEVVDADYVQPRIFWEKTLAEEPGQQDNLISNVAGHLSAVTGDKGLGSSTSGLCNVR

SEQ ID NO: 11939 - protein, 197 aa, Zea mays
  unsure (1)..(197): unsure at all Xaa locations
HPSDIERFASCGMDNTVKIWSMKEFWLYVDKSYSWTDLPSKFPTKYVQFPVLIAAVHSNYVDCTRWLGDFILSKFYLQSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGXGEDGTIWXRWDEVDHPSSRN

SEQ ID NO: 11940 - protein, 330 aa, Saccharomyces cerevisiae
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFIFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 11941 - protein, 513 aa, Zea mays
  unsure (1)..(513): unsure at all Xaa locations
MATCATDLAPLLGPAAANATGYLCSQFADTASAVDATYLLFSAYLVFAMQLGFAMLCAGSVRAKNTMNIMLTNVLDAAAGALFYYLFGFAFAFGTPSNGFIGRHFFGLQRLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGFWGALVEGPRIGRFDHAGRSVALRGHSASLVVLGTFLLWFGWYGFNPGSFTTILKSYGPAGTVHGQWSAVGRTAVTTTLAGSVAALTTLFGKRLQAGHWNVVDVCNGLLGGFAAITAGCSVVEPWAAVVCGFVSAWVLIGANALAARLRFDDPLEAAQLHGGCGAWGVLFTGLFARQEYVEEIYGAGRPYGLLMGGGXGKLLAAQIVQIVVIAGWXVSCTMGPLFYALKRLDLLRISADDEMSGMDLTRHGGFAYEDPGDNAGVGEFTLKSAQNRVEPPAEQQPGVKFRNEFKNRDEVTCLPKKKKK

SEQ ID NO: 11942 - protein, 122 aa, Zea mays
  unsure (1)..(122): unsure at all Xaa locations
LHRAQRRKPLPSIDRPQTDLYRCLKPRRDIRTPRRAWTTYNLKRKGQDDNDAXYRIKRTTQMKKLMNVYCDRQTANMNAIAFLIDGXRRLLGEHTPDELEMEDGDEIDAMLHHTGGSVPNTT

SEQ ID NO: 11943 - protein, 502 aa, Atriplex hortensis
MAFPIPARQLFIDGEWREPLLKNRIPIINPSTEEIIGDIPAATAEDVEVAVVAARKAFKRNKGRDWAALWSHRAKYLRAIAAKITEKKDHFVKLETLDSGKPRDEAVLDIDDVATCFEYFEYFAGQAEALDAKQKAPVTLPMERFKSHVLRQPIGVVGLISPWNYPLLMDTWKIAPALAAGCTTVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 11944 - protein, 179 aa, Vibrio vulnificus CMCP6
MKYSSIALLLLSSVAASTSYAGDFSLTSHDIMEGQRMAKTFEFTGFGCSGDNLSPQLSWQNAPKGTKSFAITAYDPDAPTGSGWWHWSTIDIPANVSELPRGVDLKKVGATEIRNDYGAKGFGGVCPPEGDGMHRYQFTVWALPEAKLDLDSNSSPALVGFMLNAMALDKATLTATYVR

SEQ ID NO: 11945 - protein, 392 aa, Bacillus subtilis
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGLDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 11946 - protein, 351 aa, Zea mays
  unsure (1)..(351): unsure at all Xaa locations
MALEAVVFPKEHPGCTAVKARPASLGCGFHTEELEVEDKGGVVLQGEAADALPPPGGAATTWDWDAVLCPCSTAPAAGAVEECWDVQQQQHQLLSVSPPPSSAVAASSSGRRKAAASEAARRRRRRPMAVRNTDEMESQRRNHIAVERNRRRQMNEYLSVLRSAMPPSYTQRGDQASIVAGAINFVKELEQLLQSLEAQKRRQRCTEPLAASSFAGFFIFPQYSTTAATSGAVGSSSDSAGSGGDQSGGGGGCAGARRGVADIEVSLAESHANVKVLAARRPRQLLRMVVALQXPRPSPCSHLTVTTTADHLALYSLSLKXEDECRLSPSVDDIAAAVNEILDECARGGAH

SEQ ID NO: 11947 - protein, 558 aa, Xylella fastidiosa Ann-1
MFGNGSMKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARSIIETALGKSVESAFAHFDTVPLASASISQVHAATLHDRREVVVKVLRPDIEHQISDDIALLKSLATLIEHTHPNADKIRPREIVAEIETTLAAELDLQREGANASVLRRFWEASDDIYVPEVIWSHSAERVLTLERMYGIPSDDIALLDASGIDRKALSSKGIRVFYTQVFRDNFFHADAHSGNIWVDSDPARKSNPRFIVLDFGIMGQLSQKDQYYLAENFMAIFHKDYRRIAELHVEAGWIPPHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYCLHPDGLYLGTIPVWSLISGCVGALALFSAWWRS

SEQ ID NO: 11948 - protein, 837 aa, Triticum aestivum
LSMEFLQGRALTNAIGNLELTGQYAEALKQLGQNLEDVASQEPDPALGNGGLGRLASCFLDSMATLNYPAWGYGLRYRYGLFKQIITKDGQEEVAENWLEMGNPWEIVRNDVSYPLKFYGKVVEGTDGRKHWIGGENIKAVAHDVPIPGYKTKTTNNLRLWSTTVPSQNFDLGAFNAGDHVKANEAHLNAEKICHVLYPGDESSEGKILRLKQQYTLCSASLQDIISRFESRAGDSLNWEDFPSKVAVQMNDTHPTLCIPELMRILMDVKGLSWNESWSITERTVAYTNHTVLPEALEKWSLDIMQKLLPRHVEIIERIDEELMNTIVSKYGTADISLLKQKLKDMRILDNVDLPASVAKLFIKPKEEKGKLLVESLESIAEADEKTESEEEENILSETTEKKGESDSEEAPDAEKEDPEYELDPFTKYDPQLPRVVRMANLCVVGGHSVNGVAEIHSEIVKQDVFNSFYEMWPTKFQNKTNGVTPRRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGMEASGTSNMKFAMNGCILIGTLDGANVEIREEVGEENFFLFGAHAPEIAGLRQERAEGKFVPDPRFEEVKEYVRSGVFGTSNYDELMGSLEGNEGYGRADYFLVGKDFPSYIECQQKVDEAYRDQKLWTRMSILNTAGSPKFSSDRTIHEYAKDIWDISPVIMP

SEQ ID NO: 11949 - protein, 460 aa, Membranoptera tenuis
WDPDYVIKETDVLSLFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRMPVAYLTTFQGPATGIIVERERMDKFGRPFLGATVKPKLGLSGKNYGRVVYEGLKGGLDFLKDDENINSQPFMRWKERFLYAMEAVNRSVAASGEVKGHYMNVTAATMENMYERAEFAKDLGSIIIMVDLVIGYSAIQSMAIWSRKNDMILHLHRAGNSTYSRQKIHGMNFRVICKWMRMAGVDHIHAGTVVGKLEGDPLMIQGFYNTLLLPYLDTNLPQGIFFQQDWAALRKVTPVASGGIHCGQMHQLLDYLGDDVVLQFGGGTIGHPDGIQAGATANRVALESMVIARNEQRDFVTEGPQILRDAAKTCGPLQTALDLWKDISFNYTSTDTPDFVETPTANV

SEQ ID NO: 11950 - protein, 386 aa, Aspergillus oryzae
MTGLGMETIFAKIKEEYARTDDVGKRKIQGHIRELQVGFYSDWDVVMRLSSGPLQVALAKVGIDLGIFRSLKESDTPITLAEFVKKTGASPRLLGRILRTQAAFGLIKETGPQEYTSSAFTDVFANPAAAGAVVQLFDISGPCTQILPDFLAERHYQDITSNKDCVFQKAFDSDLTMFEWMPQHPKHMESLGHLMALERPVSWVDHFPVLEELGDFPAPDKVLMVDIGGGFGQQSKALRAKFPNIPGRVIVQDIPQTLANAQPAAGVEFMEHNFFEPQPIRNAKFYYLRHVFHDWPDEQCVLILKQIIPVMGPESEILIDEMVIPSTGVPWQAAFTDLLMMNSLGGVERTRAEWDYLMKQAGLEIIQSKVYDSKEQTILVAVPRRT

SEQ ID NO: 11951 - protein, 467 aa, Chondrus crispus
  unsure (1)..(467): unsure at all Xaa locations
PYAKMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIXGXVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKQLGSIIVMVDLVIGYTAIQSMAIWARKNDMILHLHRAGNSTYSRQKIHGMNFRVICKWMRMAGVDHIHAGTVVGKLEGDPVXXXXXXXXXXXXXXXXNLPQGIFFEQDWASLRKVTPVASGGIHCGQMHQLLDYLGVDVVLQFGGGTIGHPDGIQAGATANRVALESMVIARNEGRDFVAEGPQILQDAAKTCGPLQTALDLWKDISFNYTSTDTADLVETPTANV

SEQ ID NO: 11952 - protein, 205 aa, Eucalyptus globulus subsp. globulus
MVRGKTQMKRIENDTSRQVTFSKRRNGLLKKAFELSVLCDAEVALIIFSPRGKLYEFSSSSLCKTIEKYQTRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSERPREEIRAESMDVETELFIGPPKR

SEQ ID NO: 11953 - protein, 342 aa, GIBBERELLA ZEAE PH-1
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 11954 - protein, 488 aa, Porphyra suborbiculata
MSQSVESRTRIKSERYESGVIPYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANKVALESMVMARNEGRNYVAKGPQILRDAAKTCGPLQTALDLWKDISFNYTSTDTADFVETPTANI

SEQ ID NO: 11955 - protein, 415 aa, Oryza sativa
LGVIEAHSPNPVTDPLGSVLASSQSVPATYVSLPTAVHTESIQSAAAAETKRGPSGASFIREHLRSLAPYQPILPFEVLSARLGRKPEDIIKLDANENPYGPPPEVTLGNLKFPYVYPDPESRQLRAALAEDSGLESEYILAGCGADELIDLIMRCVLEPGDKIVDCPPTFTMYEFDASVNGALVIKVPRLPDFSLDVAQIVKVVEQEKPKSIFLTSPNNPDGSIINDEDLLKILDLPILVVLDEAYIEFSSLQTRMSWVKKHDNLIVLRTFSKRAGLAGLRVGYGAFPLSIIEYLWRAKQPYNVSVAAEVSACAALQNPTYLEEVKNLLLQERDRLYDLLKEIPFLKPFPSHSNFILCEVTSGKDAKKIKEDLAKMGVMIRHYDKKELKGYIRISVGKPEHTDALMKGLKALQL

SEQ ID NO: 11956 - protein, 319 aa, Lycopersicon pimpinellifolium
MGSKYSKATNSISDASNSRYGVPFENYRVPLVDLEEATNNFDDNFFIAEGGFGKVYRGVLRDGTKVALKRHNCDSQQSIEEFRTEIEILSRRSHPHLVSLIGYCDGRNEMILIYDYMENGNLKSHLYGSDLPSMSWEQRLEICIGAARGLHYLHTNGVMHRDVKSSNILLDENFVPKITDFGLSKTRPQLYQTHVSTDVKGTFGYIDPEYFIKGRLTEKSDVYSFGVVLFEVLCARSAIVQSLPSEMVNLAEWAVESHNNGQLEQIIDPNLAAKIRPESLRKFGETAVKCLALSSEDRPSMGDVLWKLEYALRLQESVI

SEQ ID NO: 11957 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIE

SEQ ID NO: 11958 - protein, 291 aa, Triticum aestivum
  unsure (1)..(291): unsure at all Xaa locations
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNIXGFTFGVIQMVLYVFYMNKTPVASQVKEGKEAWKAPAEDHVVRDQRPARPTRARAPEVRPVTEMAAAVDVPRRCAAEAAATPGVDFARSVDVV

SEQ ID NO: 11959 - protein, 599 aa, Shewanella oneidensis MR-1
MSTPFVNPLSIPVLGFCAYSGTGKTTLLKQLIPELNQRSLRLAVIKHAHHDFDVDIPGKDSYEMRKAGARQMLVASHVRWALMTEDARDGDPELVHLLKQIEADKVDIVLVEGFKKLTLPKIELHRAAHGKPFIYTQDDNILAIACCDDTELPSELRRLDLNNVAQIADFVMEYANSWQAPNPTLPIATVDACTLGSDKNLSVSQGLAQILSHVTPVTEVEDIGLDDLDNRVLAHDSISPVDVPQQTNSAMDGYAFAYQEPMPESFNLVGEVLAGHQYSGTLKAGETVRIMTGAPVPAGADTVQPRELANEANAKVSFEGRIQQGQHVRLAGEDIGQGQVALTQATRLSAAEQGLLASLGLNRVTVYRRPTVAVFSTGDEVCQPGEALNPNCIYDSNRYTIKAMAKRLGCDVIDLGIIEDSESALETTLTKAAAQADVVISSGGVSVGDADYIKAVLARLGNIDFWRINMRPGRPLAFGKVGDSLFFGLPGNPVAVMVSFLQFVQPALRKLGGETNWQAPLFPAITDETLRSRQGRTEFIRGIYRIANDGRLHVSSTGNQGSGMLSSMVKGNCLIIIGDDADAVNAGETVFIQPFADLL

SEQ ID NO: 11960 - protein, 289 aa, Vibrio fischeri
  unsure (1)..(289): unsure at all Xaa locations
KVEVVAVNELSQPEAMAHLFQYDSTHGRFQHKVTHXQEYLYIDLPDGSQDKVRILHPADLSLLPWQSLEVDLILDXTGVYGSKSDGEKXXTAGAKKVLFSXPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKM

SEQ ID NO: 11961 - protein, 179 aa, Malus domestica x Pyrus communis
MASSMISSGTVATVSAPAQARMVAPFTGLKSSSAFPVTRKSNDITSIASNGGRVQCMQVWPPLGLKKFETLSYLPPLSTESLAKEVDYLLRKNWVPCLEFELEHGFVYRENNRSPGYYDGRYWTMWKLPMFGCTDSSQVLKELEEAKKAYPQSFIRIIGFDNVRQVQCISFIAYKPPGV

SEQ ID NO: 11962 - protein, 323 aa, Chlorobium tepidum TLS
MKKITGYKELGLVNSRELFAKAISGGYAIPAYNFNNLEQLQAIIMACVETASPVILQVSKGARSYANQTLLRHLAAGAVEYAAELGREIPIVLHLDHGDSFELCKDCIETGFSSVMIDGSHLSYEDNVSLTRKVVEFAHQHDVTVEGELGVLAGIEDEVHATKHTYTEPDQVEDFVGKTGVDSLAIAIGTSHGAFKFKPGEDHKIRLDILAEIEKRIPGFPIVLHGASSVPQDLVQMINAHGGKLKDAVGIGEDQLREAARSAVCKINIDSDGRLAMTAAVRKVLDEKPEEFDPRKYLGPARDALKQLYMHKIINVLGSNGKA

SEQ ID NO: 11963 - protein, 695 aa, Zea mays
MMMMPDGGVVSCSPPLPPRALLAASSVLCCVVWVAGPAVLCHHPSIIILYLKKKKKKKKKKKKKKKKKKKIARLRNFTVDNLWLQTMDMALASKASPPPWNATAAEQPIAKRDKAAANDSTYLYTFLEAGPPDGTSDAKAKRQTGSSETPRAGRGTPLRSVSHCPPITPPALSRPLPRARSDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIIEFAEKPKGEKLKAMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 11964 - protein, 100 aa, Zea mays
KNTIVLHNTCEGSRLAAPIILDLVLLAELSTRIQLKAEGEDKFHSFHPVATILSYLTKAPLVPPGTPVVNALAKQRAMLENIMRACVGLAPENNMILEYK

SEQ ID NO: 11965 - protein, 269 aa, Zea mays
QDLSPYTTGWGRNIPTGSASGGAGQDAPAMAAAAASGRRKRWRMMPVKSEEEVESQRMIHIAVERNRRKQMNEHLAALRSLMPPAHTQRGDQASIVGGAINFVKELEQLLQSLEARRRSPQCAAYAVDPDDAGPFADFLTFPQYSMCAVIAAPENTGHHREGGAVAEQEASGSKPSAVADVEATMVESHANLRVLSRRRPRQLLRLVLGLQGHRLTVLHLNMSSGAHMVLYSFSLKVEDDCQLTSVGEIAAAAHHIVEKINEEQNKAAA

SEQ ID NO: 11966 - protein, 248 aa, Synechocystis sp. PCC 6803
MPMAIDISNKTVLVTGANRGIGKVLVESFLEHGAAKVYAAVRKLESAAFLVDKYGNKIVPILIDLADPESIAAAAQTATDVEIVVNNAGVQKVANPLAEEAIACLKFEMETNVYGLISMAQAFAPVLKANGGGAFVQLNSVVSLKSFCNVATYSASKAAAYSITQALREVLAGQGTLVQSVHPGPIATEMTHASGRADIAESPTLVAEAIIAALQSGEFHVFPNDTMAKGMGDAYQSFGKNVIEVSFD

SEQ ID NO: 11967 - protein, 388 aa, Synechococcus sp. WH 8103
TTAFHSPTSRRRKTLQEANLLEGPLMLIKSIRGFSSNRAMTWLACAPLALMGLGIFTLSAKAEELPDLNAAFLANNLWLLVATILVIFMNAGFAMVEAGMCRQKNAVNILAKNLFVFALAVTAYWFVGYSFMYGDAAIDGWLYFGGLFFDPTVTAETISDAGLVPTVDFLFQAAFAGTAATIVSGLVAERIKFGEFVVFALILTAFIYPVAGSWEWNGGWLNSVGNAEFIDFAGSSIVHSVGAWAGLVGAALLGPRIGKYVGGKVQAIPGHNMSIATLGALILWIGWYGFNPGSQLAMDQWVPYVAVTTTLGAAGGAIGATVISTITSKKPDLTMIINGILAGLVSVTAGCGNLTLTGSWVAGLVGGIIVVFSVSALDSAGIDDPVGA

SEQ ID NO: 11968 - protein, 241 aa, Trichodesmium erythraeum IMS101
MRKTIIAGNWKMYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 11969 - protein, 180 aa, Zea mays
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRGKLGDRPVFVLVEADA

SEQ ID NO: 11970 - protein, 97 aa, Glycine max
RYIESMVADIHRTWLNGGIFMYPADAKSPNGKLRLLYEVFPMSYLMEQAGGQAFTGKQRALDLIPKKIHERSPVFLGSYDDIEQMKELYAASKEDDA

SEQ ID NO: 11971 - protein, 341 aa, Bradyrhizobium japonicum USDA 110
MPTMKAAIVRQFGKPLVIEDVPVPQPGPGEVLVKVKACGVCHTDLHAASGDWPVKPVPPFIPGHEVAGIVAALGSGVKNLKVGDAVGVAWLHDACMSCEYCETGWETLCEHQHNTGYSVNGGFAEYVIASAAFAAKLPATIDFAGIAPILCAGVTTYKGLKETEAKPGEWVVISGVGGLGHVAIQYAKAMGLKVAAVDIADDKLELARETGADLAVNALAADAVDKVLAVTGGGAHGVLVTAVSTAAFAQALKMVRRKGTVSLVGLPPGEFPTPIFDVVLKRITVRGSIVGTRRDLDEAIAFAADGKVKAEVTKVPLAEINDVFDRMKAGKIEGRMVLDFG

SEQ ID NO: 11972 - protein, 562 aa, Arabidopsis thaliana
MATEPTRSWFQIRQQKPDKSSPTKKGQEGNVKNLGRPPMNDAPSNATKQKVAAAKQYIENHYKIQKKSLQERKERRSILEQNLADADVTVEDKMDILKNFEKKEMEYMRLQRQKMGVDDFELLSIIGRGAFGEVRICKEKSTGSVYAMKKLKKSEMLRRGQVEHVKAERNVLAEVDSPFIVKLCYSFQDDEHLYLIMEYLPGGDMMTLLMRKDTLREDETRFYVAQTILAIESIHKHNYVHRDIKPDNLLITRNGHIKLSDFGLSKSLESKNFPDFKAELVDRSTKPAAEHDRLSKPPSAPRRTQQEQLLHWQQNRRTLAFSTVGTPDYIAPEVLLKKGYGMECDWWSLGAIMFEMLVGFPPFYSEEPLATCRKIVNWKTCLKFPDEAKLSIEVKDLIRRLLCNVEQRLGTKGVHEIKAHPWFRGVEWERLYESNAPYIPQVKHELDTQNFEKFDEVPSTCQTSSKSSPWRKMISSKDANFLGYTFKNLEIVDEHHIPGMAELKRKSKTANKPSLKTLFETPYPPSENQALKDLLDSPIYSEGSRGSSGSPFSRPNQSQARR

SEQ ID NO: 11973 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 11974 - protein, 468 aa, Halosiphon tomentosus
IPYAKMGYWDADYNVKHTDILALFRITPQPGVDPIEAAAAVAGESSTATWTVVWTDLLTACDIYRAKAYRVDPVPGTGDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLSGGLDFLKDDENINSQPFMRWKERFLYCMEGVNRAAAATGEVKGSYLNITAATVEQMYERAEYSRAVGSVICMVDLVIGYTAIQSMAIWARKAEMILHLHRAGTSTYARQKNHGINFRVICKWMRICGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVATESN

SEQ ID NO: 11975 - protein, 647 aa, Glycine max
MFRRSILQISSRPTLRRNPRRFVYQIPLHLSLQKNFSTASKPGVSSASGSPGKPPESNGTLSKFFIGSVALGAAFLAAYQTGYLDQYLKKEHYSVPQEPHVNATIEDLKSVQHSTDQLISPSEKFNHENPTVEITEQKIDAHFSQPEIVVEDQVDKPIPVQDKSDIAEEVTAAAKENQLPEHPQSSLTFDDPSKESVTQSDGIIGIQSTETDNAPRLEEGHHTSTSTQTSAVPDENGMKNIQPEQLEIQETERRESALGKDIEQQPTLLEEYQLRNKSERSPATYISSHGFTENSHFPEGKEALSGAMEELKDGYISENGKLVLDFLQAIHAAEKRQADLDARVFSEEKKVLKEKYEKKLKDAAARELMLAEEAAMLDRELKRERAKASRAINSLQDKMEEKLKTELEQKEIETELKFKQTQELAKAELNAAIANEKAAQIEKMAEANVNINALCMAFYARSEEARQSHATQNFALRALALEDALSKGLPIETEIASLQSYLGSTDKDSILDLVLASLPEETRSNGTDTQLQLKQKFDALKGSVRHFSFFPPGGGGMLAHSLAHLASWLKVREDDQSGDGIESVINKVEVYLAEGKLAEAADCLEESVRGTQAAEIVAGWVRQARNRAISEQAVLLLQSYANSLSLT

SEQ ID NO: 11976 - protein, 173 aa, Haemophilus somnus 2336
DKRKLFGVTTLDVLRSETFVAELKGLNVSRIAVPVIGGHSGVTILPLLSQVQYTEWKEDEIAPLTKRIQNAGTEVVEAKAGGGSATLSMAQAAARFALSLVQGLSGETVVECTYVEGDGKYARFFAQPVRLGKEGVEEILPVGTLSAFEQKALEDMLPTLRADIELGEKFVNN

SEQ ID NO: 11977 - protein, 392 aa, Ferroplasma acidarmanus
MAKITFENGKWKVPDNPTILYTDGDGIGPEIMDVTRKVVDAAVKKAYKNKKIEWKEILVGDKALKEKNDRFPEESQEAIKQYRVLLKSPLGTPIGTGFKSINVRIRVMLDLYSNIRPVSFMKGLESPLKHPENVNLTIFRENTDDLYTGIEYKYDSKEAAEIRKFFKDKLHVEISDDSGIGIKPMSKYKTQRITRAAAKFAIENNKKKITIMHKGNVMKYTEGAFREWAYETLKNEFGNYTSTDDSSKILVNDMIADNMFQQIITRPENYEVILAPNIDGDYISDAAGALIGNIGTLGGANVGDDAGMFEAVHGTAPKYAGQNVADPLGLIRGAQLMIKYLNWHEAFDVIEKAIGEAIETKKVTKDLAKFFDVPAMGTKEFGDSLVKIIDGL

SEQ ID NO: 11978 - protein, 259 aa, Glycine max
  unsure (1)..(259): unsure at all Xaa locations
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKXIAAKISNWDNVVLAYKPVWAIGTGKVATPAQAQEVHADLRKWVHDNVSAEVAASVRIIYEGSVNGGNCKKLAAQPHVDGFLVGGASLKPAGGHHKRCYCEKELKFVVRN

SEQ ID NO: 11979 - protein, 538 aa, Candida maltosa
MPVSFVHNVLEVVTPYVEYYQENLTKWYILIPTILLTLNFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMTPSTKNIAGREEFADAFNYSQTYNAYRFLLQQFYWILNGSKFNKSIKTVHKFADFYVQKALSLTEADLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTILATHRDPNIYGEDANVFRPERWFEPETRKLGWAYVPFNGGPRICLGQQFALTEASYVTVRLLQEFHTLTQDADTRYPPRLQNSLTLSLCDGANIQMY

SEQ ID NO: 11980 - protein, 488 aa, Hummia onusta
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLTGGLDFLKDDENINSQPFMRWKERFLYCMEGVNRASAATGEVKGSYLNITAATVEQMYERAEYACAIGSVIVMIDLVIGYTAIQSMAIWARKKEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAASTCGPLKAALDLWKDITFDYTSTDTPDFVEVATESR

SEQ ID NO: 11981 - protein, 71 aa, Zea mays
MNLTVSRIALVKPDKARGVEDVLLRAAQTGGISEKVSEERLISLLEQINTHTSKQTKVTIQRRRSVLDDDD

SEQ ID NO: 11982 - protein, 593 aa, Zea mays
MKVIEKILEAAGDGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDCRQIGITCPIVPGIMPINNYKGFLRMTGFCKTKIPSEITAALDPIKDNEEAVRQYGIHLGTEMCKKILATGIKTLHLYTLNMDKSAIGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLVNINQKGFLTINSQPAVNGEKSDSPTVGWGGPGGYVYQKAYLEFFCAKEKLDQLIEKIKAFPSLTYIAVNKDGETFSNISPNAVNAVTWGVFPGKEIIQPTVVDHASFMVWKDEAFEIWTRGWGCMFPEGDSSRELLEKVQKTYYLVSLVDNDYVQGDLFAAFKI

SEQ ID NO: 11983 - protein, 183 aa, Zea mays
  unsure (1)..(183): unsure at all Xaa locations
LRRRQPDGGRHQRQAVGPKKSLPAAAPAAAADPRLQGISDAIRVVPYFPKQGIMFNDFTTLLLRPRVFKDAVDLFFERLRXMGIDAVFGIEARGFLFGPAISLAIGVNFIPLRXPMKLPIEVISDNYPLXYLTDCLKMCVAPIKSSREXLLIIDFLFVTGMTLCAVIRLLELARTISSRDFYA

SEQ ID NO: 11984 - protein, 109 aa, Zea mays
  unsure (1)..(109): unsure at all Xaa locations
SLWQPCICALFPSWIYYSLTDSKIHNIVASCDVKFPINLDARAYSRGVFTSYDPELFPVLIYRMQRPAIVLVITAAXKIAVTXAQEREDTTLSSKHLVCTDSVYRTLTC

SEQ ID NO: 11985 - protein, 399 aa, Methanosarcina barkeri
MSMTIEAADTVWVLISSALVLLMLPGLALFYGGLVQRKNVLSSMMHSFVAMGVMALEWVLIGYSLAFADGNWFVGGLGHVFLKGIDVYSVTGTIPTYAYVAFQGMFAIITPALISGAIVGRVKFKSYIAFIALWGLIVYAPVCHWVWGGGFLTGEALDFAGGTVVHITSGVSSLAILTYLGKRRGFGVDSLKPHNVTLTLLGTGLLWFGWFGFNAGSSLAANEIASLAFITTLVAPAAAGFIWMALEWYHLGYPTALGFATGILAGLVAITPSAGFVTPMAAIPIGAITSFVCYNAVGLKERLGYDDSLDAFGVHGVGGIVGALLVGVFASVGGTGLLLGNSSQMLIQLQGVVVTIVYAAVGTLLIGFILNRTIGLKVSESEENIGLDKTQHGEVAYNI

SEQ ID NO: 11986 - protein, 96 aa, Lycopersicon esculentum
MAKSGYNASFLLLISMFLILLTFSNVVEGYNKLRPTDCKPRCTYRCSATSHKKPCMFFCQKCCATCLCVPKGVYGNKQSCPCYNNWKTQEGKPKCP

SEQ ID NO: 11987 - protein, 131 aa, Triticum aestivum
  unsure (1)..(131): unsure at all Xaa locations
MVLEAVMVVVDNSESSRNGDYTPTRFEAQSDAVSMIFTVITEANPESSVGLMSMXGKGPEVLVTLTTDYGKILEGLHRTKSKIRGEGHLATXIQVAGLTLKHRQNNXQRQLSSFYCNSIPEDEKTLQXGKK

SEQ ID NO: 11988 - protein, 211 aa, Glycine max
  unsure (1)..(211): unsure at all Xaa locations
MADQGLEGSQPVDLQKHPSGIVPTLQNIVSTVNLDCKLDLKTIALQARNAEYNPKRFAAVIMRIRDPKTTALIFASGGXVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKXETYTAFXNIYPVLTEFRKNQQWGSGSFSAIGYTC

SEQ ID NO: 11989 - protein, 124 aa, Triticum aestivum
MSMAVPSSLRALAPPALLPYPLGTSGSARPSPAHRAARGMMVARRRDVAVAAAAVAADAGWLERLPEKEKPLYAHSLPCIEAWLRSVGFAQSREDRAVWVAETPLWHARLSLDVTDLHIRYLKS

SEQ ID NO: 11990 - protein, 457 aa, Lactobacillus gasseri
MSKNNSETSEIKTMKRSLTNTHIQLIALGGTIGTGLFLGVGNSIELAGPAVIFIYCLVGFFLFLLMRALGELILSDIKKNTYIDFITEYLGKSIGTTTGYLYWFSWLTLAMAEITALGIYFQYWWPNLQSWIPGLITLLVLLSINLISARVFGNLEFSFAIIKIVTIIAFVILVFYLLITNSATKYGHVSWQNMVIDGGIFAKGPKGFLLGFQMVIFSFIGVELIGLTAAEAKEPKKTITRAIDQLPIRIILFYVLAILSILLAIPWDKVSTSSSPFVQALGATGIKNAGSIINFVVISAAISSTNSFIYSAGRLLFSINYKGKTKLSKHLGKLDRRQLPKNALIFSTILIALAPLLNFFLKDTFTFISATATSMFLVIWSIMIITHMTYRKKTPENELPTFKMPLYPLSDVAVLTFFLAMIIILLIFPNYRIPMISAGIIFVVLVCITHFIQKKMN

SEQ ID NO: 11991 - protein, 392 aa, Bacillus anthracis str. A2012
MKLFQPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPVCFTNPGDTILVPDPGYPDYLSGVALAKAQFETMPLIAENNFLPDYTKIDDSIAERAKLMFLNYPNNPTGATASKDFFDETIHFANKHNILVVHDFAYGAIGFDGQKPVSFLQADGAKDTGIEIYTLSKTFNMAGWRIAFAVGNESVIETINLLQDHMYVSIFGAIQDAAREALLSSQSCVIDLVNSYESRRNALISACHSIGWNVDIPTGSFFAWLPVPEGYTSEQFSDILLEKAHVAVAPGVGFGEHGEGYVRVGLLHTEDRLREAINRIDKLNFFKK

SEQ ID NO: 11992 - protein, 474 aa, Pseudomonas aeruginosa
MQTKLLINGALVAGEGESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVMRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 11993 - protein, 264 aa, Triticum aestivum
  unsure (1)..(264): unsure at all Xaa locations
MGRSPCCEKAHTNKGAWTKEEDQRLIGYIKAHGEGCWRSLPKAAGLLRCGKSCRLRWINYLRPDLKRGNFTDDDDELIIKLHALLGNKWSLIAXGRLPGRTDNEIKNYWNTHIRRKLPSRGIDPLTHRAINSDHAASNITISFEAAQRDDKGAVFRRDAEPTKVAAAAAAITHVDHHHRSNPHHQMEWGQGKPLKCPDLNLDLCISPPSHEDPMVDTKPVVKREAVVGLCFSCSMGLPRSADLQCSSFMGLRTXMLDFRSIEMK

SEQ ID NO: 11994 - protein, 176 aa, Zea mays
MAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTASEASKPSDDFPEFKLSDAPAPPAENLNGEHGPQVP

SEQ ID NO: 11995 - protein, 401 aa, Zea mays
SGGGTTASSRATLSGNRFKDRTSIEDFEIIKPISRGAFGRVFLAKKRVTGDLFAIKVLRKADMIRKNAVESILAERDILISARNPFVVRFFYSFTCRENLYLVMEYLNGGDLYSLLRNLGCLDEDMARTYIAELVLALEYLHSMNVIHRDLKPDNLLISRDGHIKLTDFGLSKVGLINSTDDLSGPDVSCALVGEHQPADAEQREQKRRQRQKQAAVGTPDYLAPEILLGMAHGPTADWWSVGVILFELLVGIPPFNAEHPQIIFDNIMNREIPWPHVPEELSSEAYDLIDRLLMENPVQRLGATGAGEVKAHPFFKDINWDMLARQKVAFIPSTDDEYDTSYFACRHAWSGAGEHGGAAGSDYDDRSEASSMSCGSSPRSDYEEDGDECGSMEEFGAPLS

SEQ ID NO: 11996 - protein, 360 aa, Buchnera aphidicola str. Bp (Baizongia pistaciae)
MDIKKLVRKNILQLVPYQSARSIGGNGDVWLNANEFPISSCLSLINISLNRYPEFQPKKLLNAYAFYLGICSEKILVTRGSDEAIELLIKTFCEPRKDKIMYFPPTYDMYDISAKILNVESIGIPLLKSFQLDLNLIFRNICGVKLIYLCNPNNPTGNLIKKQDIIALLTYTKGKALIVVDEAYIEFCAMHSIVQLIEKYSNLVVLRTLSKAFSLAGLRCGFLLSNSNIIKMLSKVINPYPISLPVSDLATQSLSKKNIDIMNSRVLDLNKTRVWFVKQLRTMYCINTIFDSVANYFLVKFHDSKLVFKELWENKVIVRDQNKKTNLKNCIRISVGTRLECFEVIRILERIDRLYKNVRR

SEQ ID NO: 11997 - protein, 183 aa, Methanosarcina mazei
MSESSIKIENVVASTKLAEEFDLTVIESEFEGAEYNKQKFPGLVYRVSDPKAAFLVFTSGKVVCTGTKNVADVHTVVGNLAKKLNSIGIKTIEDPQITVQNIVASADLHTILNLNAIAIGLGLENIEYEPEQFPGLVYRIDEPKVVVLIFSSGKLVVAGGKSPEDCERSVEVVRQQLDSMGLL

SEQ ID NO: 11998 - protein, 196 aa, Mitthyridium sp. Wall 2743
GGANKVVISAPSKDAPMFVMGVNEEKYTNEDIVSNASCTTNCLAPLAKVINDKFGILEGLMTTVHATTATQKTVDGPSNKDWHGGRSAGTNIIPSATGAAKAVGKVLPELNGKLTGMAFRVPTSDVSVVDLTVRLEKPASYDAIKAALKEASQGKMKGILGYTEDDVVSSDFITDSQSSIFDAKAGIALSDTFVNS

SEQ ID NO: 11999 - protein, 357 aa, Chrysanthemum x morifolium
MDDNSLHENRFVRDEDERPKVPYNKFSSEIPVISLKGIDDVEESSGGIKSRRAEICEKIIKACEDWGIFQVVDHGVDTKMLSEMTRLAREFFEMPAEEKLRFDMTGGKKGGFIVSSHLQGEAVQDWREIVTYFSYPIKARDYSRWPDKPKEWRAVTEKYSEDLMGLGCKLLEVLSEAMGLEKEALKDACVDMDQKVVLNYYPKCPQPDLTLGLKRHTDPGTITLLLQDQVGGLQATRDGGKTWITVEPIEGAFVVNLGDHGHYLSNGRFKNADHQAVVNSNTSRLSIATFQNPAPNAIVYPLIVNEGEKSIMEEAITFMDMYKKKMSTDLELARLKKLAKAKQQDLEKAKPIESILA

SEQ ID NO: 12000 - protein, 87 aa, Saccharomyces cerevisiae
DLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 12001 - protein, 111 aa, Archaeoglobus fulgidus DSM 4304
MVFMDDLEEIRRRKLMELQRQKELEELQKEEMRRQVEAQKKAILRAILEPEAKERLSRLKLAHPEIAEAVENQLIYLAQAGRIQSKITDKMLVEILKRVQPKKRETRIIRK

SEQ ID NO: 12002 - protein, 503 aa, ASPERGILLUS NIDULANS FGSC A4
MGLELRSMVLVSLARIYQTGFKVRRPLLAVATTNFQNIINGEKTSTTERRHGINPATGEPNPDVPVAIKEDVDRAVVAAQEAFKTWIDVPFDERRKALLAYADAIEEYVADFAKLLVQEQGKPLQFAANEVAQSAQVIRSAADVAEGLTDEIIEDSAEKKIVVRHIPIGVGAGIIPWNFPHLLTVVKLAPALITGNVIIIKPSPFTPYCGLKLVELAQRFFPPGVVQALSGDDRLGPWLTAHPGIGKISFTGSSATGKKVMESASRTLKRVTLELGGKDAAIVCGDVDVQSVAPRVISKGFFNSGQICLAVKRIYVHESIYNEFRDAAVAYAKTIEVGPGTQEGVFMGPLQNSMQYEKVKGFFADLTKEQLSLTHPDGKAFDNKAGYFIKPTIIDRPAEDSHIATEEQFGPIMPLFSWSDESDVIARANNTQMGLGASVWSRDLEQAARIAAKLQAGSVWVNTHFEADLRAPFGGHKESGIGTENGLQGLRQWCNLQTLYLKN

SEQ ID NO: 12003 - protein, 134 aa, Triticum aestivum
  unsure (1)..(134): unsure at all Xaa locations
MAPTVMASSATSVAPFQGLKSTAGLPVSRRSNGASLGSVXSNGGRIRCMQVWPIXEGIKNFETLSXWPTAQQRRASSKQVDYLXRLQXWVPCLEFKXRLGSTFRXEQQRHLPGYXRMGRYWDNVXKLXXXSGCN

SEQ ID NO: 12004 - protein, 246 aa, Zea mays
  unsure (1)..(246): unsure at all Xaa locations
HWVPRGRPGARTRPVLEGHVLDRWRLPLAADTVPLAVSLPLAGLLVFLVPPFASWRCLLPSHPQFLRHAEPDSVPRVQDPSVLPKRCSERVLCGMPCGHQCAASXAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 12005 - protein, 270 aa, Triticum aestivum
MTDVFQGYERQYCEMWGSLSRKCTGAASQEGEKLKQKASEIKSGIDGAEALIRKMPTRPPTRPPTRPPTRPAKLREYKSDLNNLKGVLKRITAGNGQQGAREELLESGMADTLVVSADQRSRLLRTTERQNQTTDRIRDSHRTMLETEELGVSIMHDLHQQRQSLLHANDTLHDVDDNIGKSRKIMGAMVRRMDRNKWIIGLLIALLVLAILVVLYFKVCALRDSLPLPYDCTFLCQLPLHFWCVSHFPCHFFGLVLQNHLMWPCLLFFL

SEQ ID NO: 12006 - protein, 239 aa, Ceratopteris richardii
MVRRKIKIKRIENATTRQVTFSKRRGGLLKKAHDLSVLCDADVGVIIFSSKGKLFQFANPSMKSVLERYYKAQGDAESADNVSSAENIEIDRITLFTEKLKALQRNVIGDDLERLSLRDLIHLEQQIHESLGRIRAKKEEMILDQLEDFKKKVTDARKTTNANSSLLDKLLDFCSSDMTSSHNFVDCEPLLISEAPQADASLAGRAATSEQSTDVRECSPPAKRLRITEDLNHSPVCME

SEQ ID NO: 12007 - protein, 224 aa, Triticum aestivum
  unsure (1)..(224): unsure at all Xaa locations
DPAHGAPAEASSEGKAAAPEPAMAEGGPGGGRRRPTLCGKHCALVESQRRTHIAVERNRRPQMTVYLAPRRSLLPPAYAPRGDQASXIVGGAINYXKELEQLLQSLEVQKSVKNRTGRSPFASSFTFPQYSTSCNATQATASDGGSGADSSGLKSEAGVADIEVTMVEGHASLKVLSRRRPRQLLRLLAGLQHLRIPPLHLIVTTVDAMVLYSFSLKVINLLLK

SEQ ID NO: 12008 - protein, 274 aa, Hordeum vulgare subsp. vulgare
SSEAAGPDGTLVRRYTTGPLCRWLTKDRGDGTLSPFAVFVVDPDHLFPWHHIAEAVTAGGPSAFERTQKWPYYEYMGKNQRLGTLFDNAMAQHSVILVTKMLERFKGFDGVQRLVDVGGGTGSTLGMITSKYKHMTGINYDLPHVIAQGLPLPGVEHVAGDMYESIPTGDAVLLQWITLMLNDDEFVKILSNCHNALPKDGKVIVVDGILPENPDSSLTARDAFTLDIIMFVLFKGAKQRTEKEFARLAKQAGFTGGIKKTYIFFNFYALEFTK

SEQ ID NO: 12009 - protein, 300 aa, Arabidopsis thaliana
SFQLPVIDFSDQNLKPGSSKWDEVKADVLKALEDYGCFEAFFDKLSVELNRSVFEAMEDLFELPIPTKQRNVSSKPFHGYLCHNLYESLGIDDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRI

SEQ ID NO: 12010 - protein, 902 aa, Saccharomyces cerevisiae
MPPASTSTTNDMITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDEGGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVPQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLQDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 12011 - protein, 279 aa, Azotobacter vinelandii
MIKKCLFPAAGYGTRFLPATKAMPKEMLPIVNKPLIQYGVEEALDAGLTQVAMVTGRGKRALEDHFDISYELEHQIRDTDKEKYLIGIRRLIDSCTFSYTRQVEMKGLGHAILCGRPLIGDEPFAVVLADDLCINLEGDGVLTQMVKLYNQFRCSIVAIQEVPPEETSKYGVIAGEMIRDDIYRVSSMVEKPKPEDAPSNLAIIGRYILTPDIFELIEQTEPGKGGEIQITDALMKQAKDGCVMAYKFKGKRFDCGGAEGYIEATNFCFENLYKLGKAY

SEQ ID NO: 12012 - protein, 617 aa, Neurospora crassa
MRTTSTSKLIGLCLSAVQQIIQECAYFANAESAFSSSSPSPPQNAGPPKPPSNVDSSRGLRLYGLEGCQEPLVELLCRQASRILQLYGTSSGDAGSSDHASLQPGAEREKAIALVKRRLELLTKTAYGKFYAYMYKEVPACWRQLYTDAAILRFAVLVLLEFNFQADAGSKEDADEKEKERRMKRKMIVDEMVKTLDLSLILAGAAGQSRGRKWVDEAFALLDDVLGDMSAVTTAAAAGGAKKGNDDEQEGERPQKKRRLSSSPNTKDEVIKGINDTWHNTPSFSTIEPFTPPVKNPISRVSAESLSIEAFQSHFAKPRPDGNPGPAPLIITGLVDHWPALTTHPWNKPAYLLSRTLSGRRLVPVEIGRSYVDEGWGQKIISFGEFLSKYIDASIPYTPSSSNVSPFLSSSSSAQPQPSSSDLLPEKDNTQIAYLAQHPLFLQLPRLRQDILIPDLCYTAPPPHPTDPSQDQPELDSPQLNAWFGPPGTITPLHTDPYHNLLVQVVGRKYVRLYGPEQTVRMRPRGKEGGVEMGNTSQVDVGVVEGWDKLEGDDKEGVKSGDEGGRENSEMGWEEDFNNVPFVDCILEPGDTLYIPIGWWHYVRGLSVSFSVSFWWN

SEQ ID NO: 12013 - protein, 580 aa, Zea mays
  unsure (1)..(580): unsure at all Xaa locations
KGPIPREIGKLSELTDLYLDVNHLTGPVPREIAAIANLQVLQLAGPGLTGSIPPQLGNLNKLTVLAMQSNQLAGAIPATLGELTQLRRLDLSFNSLFGSIPSKIAEVPLLEVFDVRNNTLSGSVPVGLRRLNGGFQYMNNKGLCGAGFSLLELCLSSEDGLKPSKPEPFGPDGTVKTRQVPQSANPDGCSGASCSKSANASQGVLIVSYVVAAVIGAAFCGLFAFSWYRRQKQKIGSSLEVSDSRLSTDHFQQKEACRRSASPLISVEYSNSWDPLSAGGAGVGSPGQVVGDSFRFNLEEVECATQYFSDMNLLGKSGFAAATYKGILRDGSVVAVKSLSKTSCKQEESDFLRGLKMLTLLQHDNLVSLRGFCCSRGRGECFLVYDFMVNGCLSRYLDVKDGSSGATVLDWPTRVSIIRGIAKGIEYLHSKKGSKPPVVXQNISADKILLDHHLAPRLSVPGLHKLLADDVVFSALKASAAMGYLAPEYAATGRFTDKSDVFAFGVVVLQVLTGRRDVSQLKVGAAAVSDLGGLVDANLDGAFSRTEAARLAAVAAYCTSETPGQRPTMEAVVQQLSSTQ

SEQ ID NO: 12014 - protein, 446 aa, Streptomyces coelicolor A3(2)
MGHADTLLAMGGAFVAAAFLARLGGRIGLPTIPLFMLAGILLGPHTPGFVLVEDAHDFEMLSALGLVLLLFYLGLEFHLDDLRSGGKRLLTAGGIYLLLNVGAGLGFGFVLGWGVREALVLAGVLGISSSAIVTKILIDLGRIGRPETRLILGVIVVEDIFLALYLAALQPVISGAHGVADTALQAGKAFGFLLVLAAAARYGTRLVGRLIHTRDNELLVISFLGAAVLVAGVSEVLGVADAIGAFMVGLILAGTPSGPRIRELVHPLRDAFAAIFFFAFGLAIDPGDLASVAGPVAAAAALTVVMNIVAGLCVARVYHYGSEPAAEIATTLVARGEFALILAAMAAGAGLDAQLAPFIAGYVLVLAVLGPIVAGRAHVLAAALRAVGGLLPGTRTPVAAADGGAGGAETEDEDDGRPEPGPVPVPAQASPAFGSSSSPEHTEAGH

SEQ ID NO: 12015 - protein, 151 aa, Dendrobium sp. XMW-2002-9
MEEDGILINYIANHGEGVWNNLAKSAGLKRTGKSCRLRWLNYLRPDVRRGNITPEEQLLIMELHARWGNRWSKIARQLPGRTDNEIKNYWRTRIQKKVKNGDAVDYSSQMIIDEACTSHTSSIEEGMAQQNYPVHPNTNPEGYRLQTTRVN

SEQ ID NO: 12016 - protein, 351 aa, Corynebacterium efficiens YS-314
MFYVTWCPLFVSGVPARRESAGKEEERCSMTHVLVLATGGTIASTAGPSGSGAVATEGIDALLNKVEVSGITVSGRNVLTTNSFLLSHRDLRLIVEAVTDALRDEGVDGVVLTHGTDTMEESAYLLDLIHDSDKPVVLTGSQRSNDGIGYDGDINLVDAITVAGAPEARGQGVLIAFAGGIHPARGTRKLHTIDPSPFGGTGPLGYVTGGAVGFHATARRGPALPPPDRGFDDTRVDVVVSHPGADATAARAAVAAGARGVVILGTGAGNGNQEIRSWVAEAVSRDITVGVSFRAVGGPVRPLYGNGGASDLADAGALLLGDLPWPQARILLAHLISIHGIVSSSMVAPYI

SEQ ID NO: 12017 - protein, 125 aa, Salmonella enterica
MSLAKNGTNLFSGDKYAGLSEQALYYIGGVIKHAKAINALANPTTNSYKRLVPGYEAPVMLAYSARNRCASIRIPVVASPKARRIEVRFPDPAANPYLCFAALLMAGLDGIKNKIHPGEAMDKNL

SEQ ID NO: 12018 - protein, 488 aa, Mastocarpus papillatus
  unsure (1)..(488): unsure at all Xaa locations
MSNSVEERTRIKNERYESGVIPYAKMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEAVNRSIAATGEIKGHYLNITAATMEEMYERAEFAKQLGSIIIMIDLVIGYTAIQSMAIWSRKNDMILHLHRAGNSTYSXXKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADXVETPTANV

SEQ ID NO: 12019 - protein, 172 aa, Staphylococcus aureus subsp. aureus Mu50
MDLKQYVSEVQDWPKPGVSFKDITTIMDNGEAYGYATDKIVEYAKDRDVDIVVGPEARGFIIGCPVAYSMGIGFAPVRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 12020 - protein, 225 aa, Zea mays
MLFLRCQPRVPSPSASAPPFRPRVGVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 12021 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 12022 - protein, 425 aa, Rhodobacter sphaeroides
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILKV

SEQ ID NO: 12023 - protein, 254 aa, Glycine max
MNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 12024 - protein, 345 aa, Dechloromonas sp. RCB
MPNTAPLRLAINGYGRIGRCFLRALLESSVAHKLQVVAINEPANLESMAYLTRFDSTHGRFPGNVEITGDKLLIDDQPIRVSHARTPEEVDWSNIDLVVECSGIYGRRPELTRFLDAGCPRLLLSHPGLSADDVDATIVTGINQQSLTGKERLVSAASCTTNAIVPLLDLIDREIGIEQAMLTTLHSVMNDQPLIDGYHHDDLRRTRSAMQSIIPVSTGLARGVERLLPQLAGRVQAKAIRVPTTNVSAIDLTINTQRPMSAHSINTLLANAAHGPLKKLVAYSEAAHASIDFNHDPHSAIVDGSQTRTSGTHLVNLFVWFDNEWGFANRMLEVADHWSRLWPTR

SEQ ID NO: 12025 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGMFLLFAGLILGMGSFVYFLLPETKQVPIEEVYLLWRQHWLWKKYVEDVDE

SEQ ID NO: 12026 - protein, 259 aa, Oryza sativa
MSTAVADVPPAAAYGFPGSAKRGKPEEVVVLMGKRRNEGFFIEEEEEEEEVLTESSSIGAPSPASSSIGENSGEEEGGDDEEEVESKLKAEDEQVGLGCLDALEESLPIKRGLSNFYAGKSKSFTSLAEATASPAAAANELAKPENPFNKRRRILATWSRRASCSSLATATYLPPLLAPDHAVAEGDEGEEEDDDSDDDERQHRGKNGGRRESAAPPLPLPPPRLTLHTQMGGMVRRNGTFRSPRSLSLSDLQNSGGSC

SEQ ID NO: 12027 - protein, 351 aa, Neurospora crassa
MTSHPEFNERTTGTEVASVFADQIRGKTILITGISPKGIGASTALAFASQSPALLILASRTKSKLEAVAEQIRTKFPSCHTNTRIELVSLDLSSQSSIRQAVTDITRLLIGGNKLDILINNAAINTTTRQTTPDDGLGLELTFGTNHIGTFLFTNLLLRNNLLSPPPPPPARIITVSSAGHRLSPMRFSDYNFSHPEKEVPAEEDYLKPLPGAFAKCTEDGYNGMVTYGQSKTANILFTLYLQKRLKGRRRGVGAYSLHPGTIETELGRDQDPEVKQEFHKIEAYWKSLDEGCATTMVAALDPALDETKGLYLVDCQISDPHPHAQDEVAAERLWKLSEEIVGEKFTLEDF

SEQ ID NO: 12028 - protein, 553 aa, ASPERGILLUS NIDULANS FGSC A4
MVNLEKTAMAAQANDEPAAERADTQLLGTSTALFDRPGLRNSVQYHGPVAVYCLNFIVFYTCWSGGDGLGWLAASVFIFIVGLAMADLASAMPTAGGLYFWTHYFSGEKWKRPLSFVVGYSNTIGLIGGVCSIDYGFATMLLAIISIARDGNWSASRPIVYGTYVGCVVVHGLIATFFARIMPKIQSACIVTNVGLVVATVLALPIGKAVNGGTINSGSYVFGQLENYTTWPSGWAFVLAWLSPIWTIGAFDSCVHMSEEATNAARAVPLGFLSLAVIAAVINTDLEAVMGTAFGQPMAQIYYDCLGKAGALGFMAVVAAVQFFMGLSLVVAASRQSWAFSRDGALPFSSFFRHVSKRIRYQPVRMVWGVVAAAITIGLLCLINAAASNALFSLAVAGNDLAWLMPILCRLVWGEDRFHPGVFYTGRLSKPIAVTAVVYLSFAILLCMFPTLGPNPNPDDMNYTVVINGALWGGALLYYMLYARKTYKGPQTTVHGSSSPSSAASTNLERKELESEEKRGTGGGDSRDGLKWAKQVPNGNGTMSAVRMRLLQS

SEQ ID NO: 12029 - protein, 429 aa, Methanosarcina acetivorans C2A [sequence omitted]

SEQ ID NO: 12030 - protein, 127 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 12031 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 12032 - protein, 358 aa, Leptospira interrogans serovar lai str. 56601
MKNVAVLSGDGIGPEVMEIAISVLKKALGAKVSEFQFKEGFVGGIAIDKTGHPLPPETLKLCEESSAILFGSVGGPKWETLPPEKQPERGALLPLRKHFDLFANLRPAIIYPELKNASPVRSDIIGNGLDILILRELTGGIYFGQPKGREGSGQEEFAYDTMKYSRREIERIAKVAFQAARKRNNKVTSIDKANVLTTSVFWKEVVIELHKKEFSDVQLNHLYVDNAAMQLIVNPKQFDVVLCENMFGDILSDEASIITGSIGMLPSASLSESGFGLYEPSGGSAPDIAGKGVANPIAQVLSAALMLRYSFSMEEEANKIETAVRKTIASGKRTRDIAEVGSTIVGTKEIGQLIESFL

SEQ ID NO: 12033 - protein, 150 aa, Agrostis stolonifera var. palustris
MSIVRWSNVFDPFSLDLWADPFDAFRSILPAASGNHDTAAFVNARMDWKETPEAHVFKADLPGVKKEEVKVEVEGGNVLVVSGERKGEGGQERQVATLERSSGKFVRRFRLPENAKVEEVKAGLENGVLTVTVPKAEVKKPEVKAIEISG

SEQ ID NO: 12034 - protein, 267 aa, Glycine max
MEGSVNERLDFGKMGYGCNHYRRRCRIRAPCCNEIYSCRHCHNEAASLLKNPFDRHELVRQDVKQVVCSVCDTEQPVAQVCTNCGVRMGEYFCNICKFFDDDTGKEQFHCDDCGICRVGGRENYFHCNKCGSCYSTSLRDNHLCVENSMRHHCPICYEYLFDSLKDTAVMKCGHTMHSECYLEMLKRDKYCCPICSKSVMDMSRAWKRIDEEIEATVMPDDYRYRKVWILCNDCNDTTEVYFHILGQKCGHCSSYNTRAIAPPVLSQ

SEQ ID NO: 12035 - protein, 202 aa, Shewanella oneidensis MR-1
MKLYLLDNFDSFTYNLVDQFRSLGCEVVIYRNDVAADYIADKLLAETAPTALVLSPGPGAPHEAGSMMELIDKVAGKVPMLGICLGHQAMVEYYGGKVERAPFVVHGKASPTFHNGTGVFANLPSPLPVARYHSLVATKVPNCLDVIATTDDMPMAILHAKHRAVGFQFHPESILTTLGSTLLTQTLVYLTQAMTSRHAGAK

SEQ ID NO: 12036 - protein, 246 aa, Oryza sativa (indica cultivar-group)
MGRGKVQLKRIENTINRQVTFSKRRSGLLKKANEISVLCDAEVALIIFSTKGKLYKYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 12037 - protein, 282 aa, Arabidopsis thaliana
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPIQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 12038 - protein, 350 aa, Zea mays
MDQSFGNLGAGAGSSSGGSNSKAAAAAVSSSSFLQLPLSTASPAYYGAPLALLHHAAAAPSSSQQQQQQHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 12039 - protein, 130 aa, Zea mays; identical to SEQ ID NO: 2189

SEQ ID NO: 12040 - protein, 355 aa, Phytophthora palmivora
MGLCASQMSDSDRQAMAKSREIEAKNEEAHRVEHEKVKLLLLGAGESGKSTVFKHMKILYGASLTEEEKRHCTPIIYNNVVTSMKMLIEQCTEMKLKGEVVCAQDFEDIRTLSDEAEVNPVVGQKIKNLWTDPGIVATWNRRAEFQIIESVKYNSNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVDVFKDFPGGIGDYELGVQYFLGKFMEMNRQPEKEIYHHVTCATDSQNVQVVFNACKDITLKQNIKGSGFM

SEQ ID NO: 12041 - protein, 470 aa, Oryza sativa; identical to SEQ ID NO: 8584

SEQ ID NO: 12042 - protein, 264 aa, Zea mays
MKNVAKCDTWCELQNPANHRVFERKLRPKPSGGGHVCLGVTRCQPRVSSPSPSASAPPFRPRVGVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 12043 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 12044 - protein, 256 aa, Pantoea agglomerans
  unsure (1)..(256): unsure at all Xaa locations
GAAGGIGQALALLLKTQLPAXSELSLYDIAPVTPGVAVDLSHIPTAVAIQGFSGEDATPSLQGADVVLISAGVARKPGMDRADLFNVNAGIVRNLIEQVATTAPKALIGVITNPVNTTVAIAAEVLKKHGVYDKNRLFGVTTLDIIRANTFVAALKGKQPDQVEVPVIGGHSGVTILPLLSQVKGVSFSDQEVADLTKRIQNAGTEVVEAKAGGGSATLSMGQAAARFGLSLVRALKGEANVVECAYVEGGGEHAR

SEQ ID NO: 12045 - protein, 513 aa, Lolium rigidum
MVMEMEPSSATLFFLSVVTLVILVSLVSRKPSSKLRRPPGPRDLPFVGSLHHLLTSQPHVALRNLAKTHGPVMRLRLGQVEAVVVSSSAAAQEVLRDNDLSFASRPNLLATEIMCYGNLDVAFAPYGAYWRALKKLCVLELLSSRKVRQFKPVRDSETMSLIKEICAAGKGGKPVKLRSLLVKCTSSVTGKATFGERCDIDLREQFMAAMEVAQIHSSGFCVGDLFPSLGFLDVATGMRYQLWRARQQLDNVVDKIISDCEARREEKKSTPTGDEDLLSLMLRIRDEGGSDFPIETINIKAIIVDLFTAGTETTSSTAEFVMSELMRNPKVMKKAQEEVWRMMENKSPQDHENHMDELPYLRMVIKETMRLHPVVPLLLPRLCRESCHVGGFEITKGTRVIINAWALATSPENWNEPEEFRPERFEDSVVVNDKGTQFKLMPFGGGRRMCPGDGFALATLELMVARLLYYFEWSLPDGMRPDELDMDVKVGTTSRRRNELRVVASPCRIPIEI

SEQ ID NO: 12046 - protein, 586 aa, Pseudomonas putida KT2440
MHAISFIQDLAVIMLVAGVVTILFHRFKQPVVLGYIVAGFIIGPHTPPFGLIHDEDTIKTLAELGVIFLMFCLGLEFSLRKLFKVGATAFIAAFLEIVLMIWIGFEIGRWFGWSTMDSLFLGAILAISSTTIIVKALNDLKMKNERFAQLIFGVLIVEDILGIGIIALLSGIAVSGTVSSGEVFSTVGKLSLFMVVALVIGILLVPRLLAYVARFESNEMLLITVLGLCFGFCLLVVKLEYSMVLGAFLIGAIMAESRQLLKIERLIEPVRDLFSAIFFVAIGMMIDPEVLIDYAWPIVVITLAVVLGKMLSCGMGAFIAGNDGRTSLRVGMGLSQIGEFSFIIAALGMTLQVTSDFLYPVAVAVSAITTLLTPYLIRAADPLSQKLGNVVPARLARVLSLYGEWLRNIQPQGESAMLAAMIRRILLQVGVNLALVIAIFFSGGYFAGRLGNWLSEWVSDVSHQKAVIWGAALLLSLPFLIAAYRKLKALSMLLAEMGVKPEMAGRHTQRVRRVIAEVIPLLSLLVIFLLLSALSASILPTSELLLVIAVVAAVVVALLWRWLIRVHTRMQIALLETLENSRENSH

SEQ ID NO: 12047 - protein, 447 aa, Ahnfeltiopsis gigartinoides
  unsure (1)..(447): unsure at all Xaa locations
ALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEDMNERAEFAKQLGSIIXMIDLVIGYTAIQSMAIWARKNDMILHLHRAGNSTYSRQKSHGMNFRVICKWMRMAGVDHIHAGTVVGKLEGDPLMIKGFYNTLLLPYLEVNLPQGIFFEQDWASLRKVTPVASGGIHCGQMHQLLDYLGIDVILQFGGGTIGHPDGIQAGAIANRVALETMVLARNEGRDYVTEGPQILQDAAKTCGPLQTALDLWKDITFNYTSTDTADFVETPTANV

SEQ ID NO: 12048 - protein, 388 aa, Lupinus albus
MVDQVQRPTIMEKVSSQLHLRSGVSSDIQSYDAAFRRPAVYQRRSFGNYSNAALQYPVMPSCRATTDLSSVATASPVFAAAPAEKGHFLIDFLMGGVSAAVSKTAAAPIERVKLLIQNQDEMIKSGRLSEPYKGIGDCFKRTMADEGVVALWRGNTANVIRYFPTQALNFAFKDYFKRLFNFKKDRDGYWKWFAGNLASGGAAGASSLFFVYSLDYARTRLANDSKAAKKGGERQFNGLVDVYKKTLASDGVAGLYRGFNISCVGIIVYRGLYFGMYDSLKPVLLTGSLQDSFFASFGLGWLITNGAGLASYPIDTVRRRMMMTSGEAVKYKSSLDAFSQILKNEGAKSLFKGAGANILRAVAGAGVLAGYDKLQVIVFGKKYGSGGA

SEQ ID NO: 12049 - protein, 294 aa, Thermosynechococcus elongatus BP-1
MLGQLHPDLIQEWLEAAATEIPRGEPLQRLPKVGSEAFAFAVVTPEQEFTLGRSRLRFPLMSAIKPFLLLYALTLWQEQVWTWVGQRPSDYPYNSVLQLTLDQGWPRNPMINSGAIALAGQLAYVGGATAFQTWLNECAGTQFEVDQEVLGAVHRHPNWQNRTLAHFLVESGRIADAEVALEIYNQVCCFQGTVEEVARLGLLLALPQAKVSDRHRQQVNVLMLTCGLYEDSPRYGLEIGLPMKSGVSGVMLAIVPRQGAIACYSPPLDKSGNSILGLYLLQRISRHLGLSPLG

SEQ ID NO: 12050 - protein, 468 aa, Pseudomonas putida KT2440
MSKSVQLIKDHDVKWIDLRFTDTKGIQHHVTMPSRDALDEDFFEVGKMFDGSSIAGWKGIEASDMILMPVDETAVLDPFTEEPTLIITCDIVDPSSMQGYDRDPRAIAKRAEEYLKSTGIGDTVFAGPEPEFFIFDEVKFHSDISGSMFKIFSEQGSWMTGADVEGGNKGHRPGVKGGYFPVPPFDHDHEIRTAMCNALEEMGQTVEVHHHEVATAGQNEIGVKFNTLVKKADEVQALKYVVHNVADAYGRTATFMPKPLYGDNGSGMHVHMSIWKDGKNTFSGEGYAGLSDTALYFIGGIIKHGKALNGFTNPSTNSYKRLVPGFEAPVMLAYSARNRSASIRIPYVGSPKARRIEARFPDPSANPYLAFAALLMAGLDGIQNKIHPGDAADKNLYDLPPEEAKNIPQVCGSLKEALEELDKGRAFLTKGGVFSDDFIDAFIELKSEEEIKVRTFVHPLEYELYYSC

SEQ ID NO: 12051 - protein, 101 aa, Triticum aestivum
  unsure (1)..(101): unsure at all Xaa locations
MIASVYMGAVNERCAYVPNRCLWADLASKFPAQXSTLAKMTAVEPATYGHCARWLVDFILSKSAYNERGLWEPTIKEQSPGEGRITPPSELPCAPLRPATT

SEQ ID NO: 12052 - protein, 561 aa, Oryza sativa
MALPNQGTVDYPSFKLVIVGDGGTGKTTFVKRHLTGEFEKKYEPTIGVEVHPLDFTTNCGKIRFYCWDTAGQEKFGGLRDGYYDPNLHFVEAVALKPPEVPIDLAMQQHEYDGSIVVQLLYQLTHYTVCSTKIHHFIRPGKAELKMRVHRISPGRKRTANQREIVIDDEYEYNKVATFLEHSRSHSLSKKRYCTEITFRKAQAKSIVGAGGSRSTHESNAEMRPSLLRYAAQALRRRDYSSAAAAAERKVAILGAAGGIGQPLALLMKLNPLVSSLSLYDIAGTPGVAADVSHINSPALVKGFVGEEQLGEALEGSDVVIIPAGVPRKPGMTRDDLFNINAGIVKGLCTAISKYCPNALVNMISNPVNSTVPIAAEVFKKAGTYDEKKLFGVTTLDVVRAKTFYAGKANVPVTEVNVPVVGGHAGITILPLFSQATPASNALSHEDIKALTKRTQDGGTEVVEAKAGKGSATLSMAYAGAVFADACLKGLNGVPDVVECSFVQSTVTELPFFASKVRLGKNGVEEVLGLGQLSEFEKEGLENLKGELKSSIEKGIKFAHAN

SEQ ID NO: 12053 - protein, 220 aa, Triticum aestivum
  unsure (1)..(220): unsure at all Xaa locations
REQKLELHRGGGRSRTSGSPGLQEFGTSATGAQCVLTSDASPADTLVLRTSFRRNYADPNEVAAVILGGGTGTQLFPLTSTRATPAVPIGGCYRLIDIPMSSCFNSGINKIFVMTQFNSASLNRHIHRTYLGGGINFTDGSVEVLAATQMPGEAAGWFRGTADAVRKFIWVLEDYYKNKSIEHILILXGDQLYRMDYMELVQKHVDDNADITLXCXPVGK

SEQ ID NO: 12054 - protein, 301 aa, Fusobacterium nucleatum subsp. nucleatum ATCC 25586
MSLKEAFMKKVTKAVIPAAGLGTRVLPATKALPKEMLTIVDKPSLQYIVEELVDSGITDIVIITGRNKNSIEDHFDFSYELENTLKNDNKLDLLEKVSHISNIANIYYVRQSMPLGLGHAVLKAKSFIGDEPFVIALGDDIIYNPEKPVTKQMIEKYELYGKSIIGCQEVAKEDVSKYGIAKLGHKVDETTYQMLDFLEKPSVNEAPSRTACLGRYLLSGKVFKYLEETKPGKNGEIQLTDGILAMMRDNEEVLAYNFIGKRYDIGSKFGLLRANIEFGLRNEETKEEVKEYLKKLDIEKI

SEQ ID NO: 12055 - protein, 455 aa, Methanothermobacter thermautotrophicus str. Delta H
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 12056 - protein, 379 aa, Xylella fastidiosa Dixon
MQPVGAVRRRGRRSSGGAIGKHAICGRQVNAGALYRGMVWGAVRWAGVWWMLRSMGRYSDAHSVDFAFFYVLTRDKSFMQVTSKLPQVGSTIFSVMSQLADVYGAVNLGQGFPDFPVPLRLQEALAGAVREGHNQYPPMIGVAGLRQGIAAKVLRCYGAQVDVDVEITVTSGATEAIFNAIHAVVGAGDEVIVLDPAYDCYEPGIVLAGARAVHVPLDAVSFTVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPPALSAEFRKVHQYNTFTSFGPAQYAFAAMLREEPEYVEQVGLFYQARRDCLREQL

SEQ ID NO: 12057 - protein, 416 aa, Helicobacter pylori 26695
MENSTLYIVIAGLWLAVGFGIFLKKLDMPVIIGYICTGTVLAAFFKINDFDLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSNVNLLILKTFISAGIILVLLLLPGKKGANLILEQAKDTRLPEIFIGTILVIVCSAAGLSHFFGFSMSLGAFIVGMAISKSRYKINVQEEFAQLKNLFLALFFITIGMQINVSFFMEKFFVVIFLLILVMGFKTAIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 12058 - protein, 422 aa, Oceanobacillus iheyensis HTE831
MTQAEKIVVENGKMNVPDTPIIPFIEGDGTGPDIWASAQKVIEAAVDKAYDGKKSIEWMEVYAGQKAYDKTGEWLPKDTLDKINEYKIAIKGPLTTPIGGGIRSLNVALRQELDLFTCLRPVRYFEGVPSPVKRPEEVDMVIFRENTEDIYAGIEWQKGSDEVKKVINFLKEEMGVKNIRFPETSGIGVKPVSEEGTKRLVRSAIDYALNEGRKNVTLVHKGNIMKFTEGAFKNWGYEVAEQEYGDKVFTWAEYDRIVEAEGKDAANKAQDEALASGKILVKDAIADIFLQQVLTRPKEFDVVATMNLNGDYISDALAAQVGGIGIAPGANINYDTGHAIFEATHGTAPKYAGLDKVNPSSVILSAVLMLEHLGWREAADLITKSMDKTIGSKVVTYDFARLMDGAKEVKCSEFGQELIKNM

SEQ ID NO: 12059 - protein, 347 aa, Oryza sativa
  unsure (1)..(347): unsure at all Xaa locations
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLXSFPIVFVVENNLWAIGMSHLRATSDPEIYKKGPAFGMPGVHVDGMDVLKVREVAKEAIERARRGEGPTLVECETYRFRGHSLADPDELRRPGKGHLPCSFFSSMV

SEQ ID NO: 12060 - protein, 457 aa, Yersinia pestis CO92
MEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 12061 - protein, 238 aa, Glycine max
HAVRYINVVPFPTLFFHPPLHVSLNPLRVYIIDFFIFVCIKFSSFNPSVEELVLQDESLSWDHKHLNLNNQCLIKDNHGSEHFWDFSVQSDETVMGLVGRESEHLPHVGYLKRLLSGDLDLSVRKEALDWIWKAHAYFDFGPCSLCLSVNYLDRFLSVYELPRGKSWSMQLLAVACLSIAAKMEEIKVPPCVDLQFAFEAKDIQRMELLVLSTLRWKMQASTPFSFLDYFLRKITCDQ

SEQ ID NO: 12062 - protein, 474 aa, Oryza sativa (japonica cultivar-group); identical to SEQ ID NO: 4466

SEQ ID NO: 12063 - protein, 497 aa, Geobacillus thermoleovorans
MTMISAQTTEADLWIDGEWRPAASGERFDVIDPATGEVTARVANAGEDDVDAAVAIAEEAFSVRRWLAISPLERGRILRRIAELIRQHHCELAQLMTRENGMPINLALFIEIPLADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTVPFGGYKQSGLGRELGMQALDAYLETKTVICDLNDRPMTLF

SEQ ID NO: 12064 - protein, 506 aa, Saccharomyces cerevisiae
MPTLYTDIEIPQLKISLKQPLGCFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINQSNDEDVTVPFGGFKMSGIGRELGDNVVDTYLQTKSVHMDLSLDN

SEQ ID NO: 12065 - protein, 484 aa, Agrobacterium tumefaciens str. C58
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAEEARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCIGNIL

SEQ ID NO: 12066 - protein, 399 aa, Methanosarcina mazei Goe1
MKMAINGADTVWVLLSSALVLLMVPALALFYGGLVQRKNVLSSMMHSFVAMGVLALEWIIIGYSLAFSEGNWFIGGLENVFLSGIDPYSVTGTIPTYAFVAFQGMFAIITPALISGAIVGRVKFKSYIAFILLWGLIVYAPVCHWVWGGGFLTGEALDFAGGTVVHITAGMSSLAILAYLGKRRGYGVDSLKPHNVTLTLLGAGLLWFGWFGFNAGSALAANEIAALAFMTTLVAPAAAGFVWMALEWAHLGRPTALGFATGILAGLVGITPAAGFVTPVAAIAIGAIASFICYQAVMFKNRLGYDDSLDAFGVHGVGGIVGAILTGVYASVGGEGLLLGNSAQLMIQLQGVVITIVYAMACTLLIGFVLHKTIGLKVSESEEIIGLDKTQHGEAAYNI

SEQ ID NO: 12067 - protein, 464 aa, Escherichia coli K12
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 12068 - protein, 214 aa, Triticum aestivum
MAMAAAASPSKILIPPHRASAATAAASTSCDSLRLLCAPRGRRQRPRGLVARPAPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQGPDNPDWFQGTADAVRQYLLFEEHNVMEYLILAGDHLYRILY

SEQ ID NO: 12069 - protein, 224 aa, Shewanella oneidensis MR-1
MTQQTQYGFYFDSSKCTGCKTCHIACKDRMTGLVRAKDDVMNNGVANLPGIIWRRVYEYGGGNWSQNVDGSFEQNVFAYYMSIGCNHCSQPVCVKACPTGAMHKRREDGLVQVATELCIGCESCARACPYDAPQLDIERKVMTKCDGCSDRLAEGKKPICVDSCPLRALDFDTMDNLRAKYGEGDGHIAPLPSPSITSPNLIIKANRNGQPVGGSGQLLNPAEV

SEQ ID NO: 12070 - protein, 206 aa, Zea mays
MEAQNGYSPLLAVDDHEAAAAAAIHATGAGDEGDDVKLRLLGYKQQLKRDLSVVANFSVSFSIVSVVTGVTTLFGTGLQFGGPATMVYGWPIAGAFTAAVGLAMAEICSAYPTSGGLYFWSARLCTHRRWGPFAAWLTGWFNVVGQWAVTTSVDYSLAQLIQVIILLATGGKNGGGYLASKYMVIGFHAAILLSHTPSPIWTDEYV

SEQ ID NO: 12071 - protein, 392 aa, Zea mays
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKISMPAHLMFDGQDDKLFEHFSMVAQRLGVYTARDYADILEFLVDRWKVADLTGLSGEGNKAQDYLCTLASRIRRLDERAQSRAKKAGTLPFSWVYGREVQL

SEQ ID NO: 12072 - protein, 253 aa, Zea mays; identical to SEQ ID NO: 3990

SEQ ID NO: 12073 - protein, 532 aa, Glycine max
MAVGGFTNAAGGADFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGFFFIGGVVLNAAAQDLAMLIVGRILLGCGVGFANQAVPVFLSEIAPSRIRGALNILFQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRVSIICIEYFRL

SEQ ID NO: 12074 - protein, 357 aa, Populus tremuloides
MGSLETERKIVGWAATDSTGHLAPYTYSLRDTGPEDVLIKVISCGICHTDIHQIKNDLGMSHYPMVPGHEVVGEVVEVGSDVTKFKAGDVVGVGVIVGSCKNCHPCKSELEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINTPLQFVSPMVMLGRKSITGSFIGSMKETEEMLEFCKEKGLASMIEVIKMDYINTAFERLEKNDVRYRFVVDVAGSKLIP

SEQ ID NO: 12075 - protein, 103 aa, Dechloromonas sp. RCB
MDVKEEGDSYLVHAELPGVKKEDIHVVVDGNQVSISAETKQEKEVKEGDRVLRSERYFGKVSRSFLLEQDLDDTKATAKFNDGVLELTLPKRTASPNKKLNIE

SEQ ID NO: 12076 - protein, 575 aa, Vitis vinifera
SARAPSVISSSEATLGRHLARRLVQIGVSDVFSVPGDFNLTLLDHLIAEPGLKNIGCCNELNAGYAADGYARSRGVGACVVTFTVGGLSVLNAIAGAYSENLPVICIVGGPNSNDYGTNRILHHTIGLPDFSQEFRCFQTVTCYQAVVNNLEDAHEQIDTAISTALKESKPVYISISCNLPGIPHPTFSREPVPFCLAPKVTNQMGLEAAVEAAAAFLNKAVKPVMVGGPKLRVAKACEAFVELADACGYPVAVMPSAKGLVPECHPRFIGTYWGAVSTAFCAEIVESADSYIFAGPIFNDYSSVGYSLLLKKDKAILVQPERVVIGNGPAFGCILMKDFLKALSKRLKCNTTAYENYHRIYVPEGQPLRSDPKEPLRVNVLFQHIQKMLSSETAVIAETGDSWFNCQKLKLPKGCGYEFQMQYGSIGWSVGATLGYAQAVPNKRVISCIGDGSFQVTAQDVSTMIRCEQRTIIFLINNGGYTIEVEIHDGPYNVIKNWNYTGLVDAIHNGEGKCWTTKVVCEEDLINAIETATGSKKDCFCFIEVIAHKDDTSKELLEWGSRVSAANSRPPNPQ

SEQ ID NO: 12077 - protein, 379 aa, Zea mays
MAKLGPGQGLGCEAAEGSLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSSRN

SEQ ID NO: 12078 - protein, 231 aa, Glycine max
  unsure (1)..(231): unsure at all Xaa locations
MSHAFTLIVADCYLFVCQVAKRLEKFQRDWGGAPTQKDGIINLGRGFPNFDGPEFIKEAAIQAIRDGKNQYARGFGVPELNIAIADRFKKDTGIVVDPDKEVTVTTXLEAIAATVLGLINPGDEVILFTPLYDCYEANLTMAGAKIKSISLHPPDFAVPIEKLKSIVSSNTRAILINTPHNPTGKMFTLEELNAIASLCIENDVLVFADEVYHKLAFDVEHISIASLPGMF

SEQ ID NO: 12079 - protein, 311 aa, Vibrio parahaemolyticus RIMD 2210633
MKVAVIGAAGGIGQALALLLKNRLPAGSDLALYDIAPVTPGVAADLSHIPTPVSIKGYAGEDPTPALEGADVVLISAGVARKPGMDRADLFNVNAGIVKSLAEKIAVVCPKACVGIITNPVNTTVPIAAEVLKKAGVYDKRRLFGITTLDVIRSETFVAELKGKDPSDIRVPVIGGHSGVTILPLLSQVEGVEFTAEEVEALTKRIQNAGTEVVEAKAGGGSATLSMGQAACRFGLALVRALQGEEGVVECAYVEGDSEHAPYFAQPVKLGKEGVEEVLSYGELSDFEKAALDGMLETLNGDINIGVEFAK

SEQ ID NO: 12080 - protein, 463 aa, Acanthopeltis japonica
MGYWDPDYVVKETDVLALFRVTPQPGVDPVEASAAVAGESSTATWTVVWTDLLTACDLYRAKAYKVDLVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERYLYSMEGVNRSIAASGEIKGHYMNVTAATMEDMYERAEFAKQLGTIIIMIDLVIGYTAIQTMAIWARKNDMILHLHRAGNSTYSRQKNHGMNFRVICKWMRMAGVDHIHAGTVVGKLEGDPEMIRGFYNTLLFTHLDMNLIQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 12081 - protein, 197 aa, Haemophilus influenzae Rd
MTALLKIGLVSVSDRASAGVYQDQGIPELQAWLEQALVDPFHLETRLIPDEQPVIEQTLKELVDEQGCHLVLTTGGTGPAKRDVTPDATLAVADREMPGFGEQMRQVSLHFVPTAILSRQVGVIRKESLILNLPGQPKAIKETLEGVKDKEGNVLVKGIFSAVPYCLQLINGLYIDTKPEIIESFRPKSARRENLEK

SEQ ID NO: 12082 - protein, 418 aa, Halymenia dilatata
ETDVLALFRVTPQPGVDPIEASAAVAGESSTATWTVVWTDLLTACDLYRAKAYKVDAVPNSSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEAVNRSIAATGEMKGHYMNVTAATIENMYERAEFAKQLGTVIIMIDLVVGYTAIQTMAIWARRNDMILHLHRAGNSTYSRQKSHGMNFRVICKWMRMAGVDHIHAGTVVGKLEGDPVMIRGFYNTLLLTHLDVNLPQGLFFEQDWASLRKVTPVASGGIHCGQMHQLLDYLGEDVVLQFGGGTIGHPDGIQAGATANRVALEAMVIARNEGRDYVAEGPQILQDAAKT

SEQ ID NO: 12083 - protein, 711 aa, Cytophaga hutchinsonii
MKKPTSKTEGTDPKFQDLQKNTSDATDQFMTTDQGLKINDDNNSLKAGERGPSLLEDFILREKITHFDHERIPERIVHARGSAAHGYFQVHESMAQYTKAGFLQDPSIKTPVFVRFSTVAGSRGSTDLARDVRGFSVKFYTAEGNYDLVGNNMPVFFIQDAAKFPDLIHAVKPEPHHEMPQAASAHDTFWDFISLMPESMHMIMWVMSDRAIPRSLRMMEGFGVHTFRFINKNNESHFVKFHWKPKQGTHSVVWDEAQKISGKNCDFHRQDLWEAIESGNFPEWELGVQLIPEADEHKFAFDLLDPTKLVPEEEVPVTIIGTMVLNRNPDNFFAETEQVAFHPGHLVPGIDFTNDPLLQGRLFSYTDTQLSRLGSPNFHEIPINRSVAPTHNNQRDGHMRQEINTGRVSYHPNSLGGGCPFQAKMAEGGFTSFNERIDAKKVRERSESFSDHFSQATLFFNSQTEVEKGHIIKALRFELGKVETEAIRVRMVGLLSQIDKTLATKVAAGLGIAVPAPAFPMNHGVGADDDFEKHEPKKAEQVTKSSDALTILRNPTVTPSIATKQIAFLCADEVSGASVVSYKNALERKGAVVKIIAPHLGFIKTEEGKKIKVDQSLLIAASVLFDAVFIPAGKGIKQLKGIKEVAEFITDTYKHCKVIGGEDEGALVIQSVQAIMEAGKNADEGIVLNKDTTAFVKALGKHRFWEREEAV

SEQ ID NO: 12084 - protein, 510 aa, Avena sativa
MFIESFRVESPNVRYGAGEIESEYRYDTTELVHESHNGASKWVVRPKSVNYHFKTDTNVPKLGVMLVGWGGNNGSTLMAGVIANREGISWATKDKVQQANYFGSLTQASTIRVGSYNGEEIYAPFKSLLPMVSPDDIVFGGWDISSMNMADAMTRAKVLDIDLQKQLRPYMESIVPLPGIYDPDFIAANQGSRANNVIKGTKKEQMEQVIKDIREFKEKNKVDKVVVLWTANTERYSGVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVASNNILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 12085 - protein, 315 aa, Cytophaga hutchinsonii
MRDISGKQITLRTATGIGMVTCSASTVDHIKNDTLPKGNMFDVARAAAFLAAKNTSQLIPHCHPVGIDGMSVEFEILDPVKHQQELAIPLDGLYGVVIRSEIKSIGRTGIEIEALTGISIAALTVYDLLKNIDKHLSIGPIRLLEKTGGKSGQKYFNTPPKCAVLVCSDSTFEGKREDRSGKKIIEILNEHGITAAAYDIVPDERIHIQEKIRAWVNEDYAYIFTTGGTGLGPRDKTVEAVKELLERDADGIAEAMRVYGQMRTPLAMMSRAVAGAINETLIVTLPGSSNGVRECLEAIMPAVFHARKMMKGGGH

SEQ ID NO: 12086 - protein, 165 aa, Zea mays
MGCSLSGLNALYDAATGGGDVWINERRFRVLRQIGEGGFAFVYLVKEHDASSYAARDRHPSHVSDDGTYAMKKVLIQSREQLDLVKEEIRVSSLFNHPNLLPLLDHAIIAVKSTQGDWSHEAYLLFPVHLDGTLFDNAAVMQPRKEFYSVVDVFAIFQHICEAMK

SEQ ID NO: 12087 - protein, 78 aa, Triticum aestivum
ATPADAALMMQLGCDGVFVGSGIFKSGDPARRARAIVQAVTHYSDPTILADVSTGLGEAMVGINLNDPKVERYAARSE

SEQ ID NO: 12088 - protein, 290 aa, Actinobacillus actinomycetemcomitans
MKGIILAGGSGTRLYPITRGVSKQLLPVYDKPMIYYPLSVLMLAGIRDILIITTPEDNESFKRLLGDGSNFGVNLQYAIQPSPDGLAQAFLIGEAFINGDSCCLVLGDNIFYGQHFTQMLQRAVARPYGATVFGYLVKDPGRFGVVEFDENFKAVSIEEKPAQPKSNYAVTGLYFYDNRVVDFAKQVKPSARGELEITTLNEMYLKDGSLNVQLLGRGFAWLDTGTHESLHEAASFVRTIERVQGLQVACLEEIAWRNGWLTSEQVEILARPMVKNEYGQYLLRLINEEK

SEQ ID NO: 12089 - protein, 118 aa, Desulfitobacterium hafniense
MQAYAEGFAILGRKAEFGLDLHQIAQIWRHGSVVRSWLLDLSADALGKNPSLQGIAPYVEDSGEGRWTVAEAIDLDVSAPVITASLMERLRSREKDSFADKLLAAMRNEFGGHAIRKE

SEQ ID NO: 12090 - protein, 180 aa, Saccharomyces cerevisiae
SGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 12091 - protein, 444 aa, Pseudomonas syringae pv. syringae B728a
MLPPETQRLIEQHGIKYVLAQFVDIHGSAKTKSVPVTGLEMVAEDGAGFAGFAICGMGMEPHGPDFMARGDLSSLTPVPWQPGYGRVVCIGHVDGKPWPYDSRYVLQQQVERLSQRGWSLNTGLEPEFSLFKRDVTGSLQMVDASDNLDKPCYDYKGLSRSREFLERLTEALQPVGFDIYQIDHEDANGQFEINYTYSEAMESADRFTFFRMAAGEIANDMGMICSFMPKPDPKRAGNGMHFHLSIASASNKNLFHDASDPSGMGLSTLAYHFAAGLLAHGPALCAFAAPTVNSYKRLVVGNSLSGATWAPAFIAFGANNRSAMVRVPYGRLEFRLPDAGCNPYLVSAAIIAAGLDGIDRQLEIDHVCNENLYKLSLEEIAARGIKTLPQSLNEACDALQADPLFGEVLGSEIVDEFIRLKRMEWVEYSRHVSDWEVKRYIEFF

SEQ ID NO: 12092 - protein, 133 aa, Zea mays
  unsure (1)..(133): unsure at all Xaa locations
RQLPSPSIYLPDTDLYRCLIDDKEDKKPVKVGAHIILEAXGQHGNAAIFLIKRSTQVXKLFNAYCHRQAEDLECTYAFLNCMACRFXEDQTPHPLEMEDVVQIDAMLLPNRRQRSYHHLEANAAEPLLALRSA

SEQ ID NO: 12093 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEATFVEPSKRGKYCVVFDPLDGSSNIDCGVSIGTIFGIYLIKEDHEPTIEDVLQPGKNMLAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 12094 - protein, 463 aa, Nannochloropsis salina
EMGYWDANYTIKDTDVLALFRITPQPGVDPIEAAAAIAGESSTATWTVVWTDLLTACDVYRAKAYKVDSVPGTSDQFFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNTLLQTSLDINLPQGIFFEQDWASLRKTLPVASGGIHCGQMHQLLNYLGEDCVLQFGGGTIGHPDGIASGATANRVAMECVLLAKYEGKDYINEGPKILRAAAESCAPLRTALDLWKDIAFNYTSTDTADYVETTTKQ

SEQ ID NO: 12095 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 12096 - protein, 218 aa, Glycine max
MVLTLYMCLISILKLFSPVSVVQFILKNLHYFLNFLFSTFQYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQWYGGGSASFAIGYTCCNPWARNIMNQYHCLYYFFFFVQLSEYNCVRCRAEVFLIEMTKFFTQFLFWVIYLYKF

SEQ ID NO: 12097 - protein, 395 aa, Oryza sativa
MDPSAAAAAADDDDDYHATTGGMEPRGEEDNGASTRGVTGANADEDDAASAVSLDTISNDSILLPPEPTSANLASLLRARKLILVVDLDHTLINSTRFAHLSDDEKANGFTERTGDDRSRGLFRMGLFRMITKLRPFVHEFLREASAMFEMHVYTLGNRNYATAVAKLLDPDGAYFGERIISSGESSQPDRKSLGDVFGWAPEMERAAVVILDDTAEVWKGYRDNLIEMERYLYFASSRGKFGIAVRSLAERNRDESEREGALAVALRVLRRVHGEFFSGSVCSGSFADVREVIRQARREVLRGCTVAFTGVIPSGDGGRASDHPVWRRAEQLGATCADDVGEGVTHFVAGKPVTRKALWAQTHGKFLVDTEWINAAHFRWSKPEERMYPVKGEH

SEQ ID NO: 12098 - protein, 468 aa, Chorda filum
IPYAKMGYWDADYNVKDTDILALFRITPQPGVDPVETAAAVAGEPSTATWTVVWTDLLTACDIYRAKAYRVDPVPGTSDQYFAYIAYECDLFEEGSLANLTASIIGNVFGFKAVKALRLEDMRIPYAYLKTFQGPATGIIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAASTCGPLKAALDLWKDITFDYTSTDTPDFVEQATESK

SEQ ID NO: 12099 - protein, 162 aa, Triticum aestivum
MAGMVFGLENPMMTALQHLLDIPDGEAGGAGAPRGEKQGPTRAYVRDARAVAAAPADVKELPGAYAFVVDMPGLGSGDIKVQVEDERVLVISGERTREEEEDPKYLRMEPRMGKLMRKFVLPENADMEKISPACRDGVLPVPVEKLPPPEPKKPKPIQVQVA

SEQ ID NO: 12100 - protein, 779 aa, Saccharomyces cerevisiae
MPTTYVPINQPIGDGEDVIDTNRFTNIPETQNFDQFVTIDKIAEENRPLSVDSDREFLNSKYRHYREVIWDRAKTFITLSSTAIVIGCIAGFLQVFTETLVNWKTGHCQRNWLLNKSFCCNGVVNEVTSTSNLLLKRQEFECEAQGLWIAWKGHVSPFIIFMLLSVLFALISTLLVKYVAPMATGSGISEIKVWVSGFEYNKEFLGFLTLVIKSVALPLAISSGLSVGKEGPSVHYATCCGYLLTKWLLRDTLTYSSQYEYITAASGAGVAVAFGAPIGGVLFGLEEIASANRFNSSTLWKSYYVALVAITTLKYIDPFRNGRVILFNVTYDRDWKVQEIPIFIALGIFGGLYGKYISKWNINFIHFRKMYLSSWPVQEVLFLATLTALISYFNEFLKLDMTESMGILFHECVKNDNTSTFSHRLCQLDENTHAFEFLKIFTSLCFATVIRALLVVVSYGARVPAGIFVPSMAVGATFGRAVSLLVERFISGPSVITPGAYAFLGAAATLSGITNLTLTVVVIMFELTGAFMYIIPLMIVVAITRIILSTSGISGGIADQMIMVNGFPYLEDEQDEEEEETLEKYTAEQLMSSKLITINETIYLSELESLLYDSASEYSVHGFPITKDEDKFEKEKRCIGYVLKRHLASKIMMQSVNSTKAQTTLVYFNKSNEELGHRENCIGFKDIMNESPISVKKAVPVTLLFRMFKELGCKTIIVEESGILKGLVTAKDILRFKRIKYREVHGAKFTYNEALDRRCWSVIHFIIKRFTTNRNGNVI

SEQ ID NO: 12101 - protein, 470 aa, Zea mays
  unsure (1)..(470): unsure at all Xaa locations
MGFGMGNNNNGASSSSSRLDPAXAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRVAVDVMLVLSQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSIIAFSRATTIHVLSVVREWLVLDGGNLYAFRTTDFSYSR

SEQ ID NO: 12102 - protein, 451 aa, ASPERGILLUS NIDULANS FGSC A4
MTDEEVATSDSITTPRKYPVKWYRSTYFNALILGLCNFFAPGIWGAMNSLGGGGASKPYLVNTANALTFCLMVLSCFFGSVIVKFIGIKWTLIVGTMGYAPYAAGIYTQVRYDSDWLTLFGAALCGISAGLFWMAESAIALSYPEPQNQGRFLGFWLSFRVGGQIVGGAINLGVNVHRNTAGSVSYVVYYIFIALQAFGPFVGLLLTSPGKVERTDGVPVKLRIANNVWFEIKAMTKLLLSKKFVLIIPLIWQATFGEAVMFTYNSLWFSVRARALGSFVSGIMAIVSGNLLGAFLDSKISLKLRSRVGFIIVLGLQGAWWLWGTIVVTDFHKTNPVFDWSDSGDSYGHRDVELRGNRYFIVGNLAKDEEEVVRIASLLRGMESASQAVSYGLSSISIMASVGSIYLNFGLWALALFPAWLIIREIGVSLGDKKVERETRTAREVSGAGAH

SEQ ID NO: 12103 - protein, 179 aa, Triticum aestivum
  unsure (1)..(179): unsure at all Xaa locations
MAPTVMASSATSVAPFQGLKSTAGLPVSRRSNGASLGSVSNGGRIRCMQVWPIEGIKKFETLSYLPPLSTXEALLKQVDYLIRSKWVXPCLEFSKVGFIFREHNASPGYYDGRYWTMWKLPMFGXCTDATQVINEVEEVKKEYPDAYVRIIGFDNMRQVQCVSFIAFKPPGXCEESGKA

SEQ ID NO: 12104 - protein, 333 aa, Bacillus cereus ATCC 14579
MAEVKEKRHEELGLSDEQVLEMFRTMLLARKIDERMWLLNRAGKIPFVISCQGQEAAQVGAAFALDREKDYALPYYRDMGVALTFGMTAKELMLSAFAKAGDPNSGGRQMPGHFGQKKNRIVTGSSPVTTQVPHAVGIALAGKMEKKDLVTFVTFGEGSSNQGDFHEGANFAGVHKLPVIFMCENNKYAISIPVEKQLACKNVSDRAIGYGMPGYTIDGNDPLAVYKAVKEAADRGRRGEGPTLIETVSYRLTAHSSDDDDRVYRDKEEVEEAKKKDSIITFAAYLKEAGVLTEESEKQMLDEIMHIVNEATEYAENAPYAAPEDALKHVYAE

SEQ ID NO: 12105 - protein, 107 aa, Saccharomyces cerevisiae
MSRHQFDLIMCLKQPGVQTGLLCEKCDGKCPICDSYVRPKRKVRVCENCSFGKQAKNCIICNLNVGVNDAFYCWECCRLGKDKDGCPRILNLGSNRLDRHFEKKKKV

SEQ ID NO: 12106 - protein, 816 aa, Pseudomonas fluorescens PfO-1
MTQEPLVREAEVAAFRDAVLTKLTYAVGKDPDHAFDHDWFEAIALAARDHMVEHWMDHTRQIYRKGQKRVYYLSLEFLIGRLLYDSLSNLGLLDVAREALTELGVDLERIRILEPDAALGNGGLGRLAACFMESMSTLGIAGHGYGIRYEHGLFRQAIVDGWQQEQTEHWLDFGNPWEFERPEVVYPIGFGGSVETVTDANGNSRQVWHPAETVRAIAYDTPVVGWRGASVNTLRLWRARAMEDLHLERFNAGDHLGAVAEVARAESISRVLYPADSTEAGQELRLRQEYFFVAASLQDLLRRHRNMHTSVLTLGDHAAIQLNDTHPSIAVAELMRQLVDVYDVAWDAAWQVTVDTLSYTNHTLLPEALETWPVGLMERMLPRHMQIIYLINAQHIDSLRAKGIHDFDVLRAVSLIEEDNGRRVRMGNLAFLGSHSVNGVSGLHTQLMRKTVFAELHKLYPERINNKTNGITFRRWLYQANPELTSMLVDALGPDVLDNPEERLLDLEPFAEKPAFRKAFAEQRLHSKKALAYLIHERLGIAVNPAAMFDVQVKRIHEYKRQLLNLMHTVALYQAIRAEPEIDWVPRVKIFAGKAAASYHQAKLIIKLTNDIARVVNNDPTVRGLLKVVFLPNYNVSLAESIIPAADLSEQISTAGFEASGTSNMKFGLNGALTIGTLDGANVEMCENIGAEHMFIFGLSAQQVEARKQNHEFSAVPDIAASHRLNDVLQAIRSGVFSPDDTSRYTGLIDSLVDYDRFFVCADFDSYWEAQMRVDAHWHDANNWWRSAVLNTSRMGWFSSDRTIREYATDIWKALE

SEQ ID NO: 12107 - protein, 353 aa, Leptosphaeria maculans
MGCGMSTEEKEGKQRNEEIENQLKRDKMMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQHETKQIYTHFTCATDTMQIRFVMAAVNDIIIQENLRLCGLI

SEQ ID NO: 12108 - protein, 1021 aa, Actinoplanes sp. 50/110
MDERLKSHIVRALLPVLVGAAGGLPAPRAAQAESPPDRPSHAEQLYLVMPDRFANGDTGNDQGGLTGDRLTTGYDPTDAGFYHGGDIQGVIDKLDYIQGLGTTAIWLTPIFKNKPVQGTGPNASAGYHGYWITDFTQVDPHFGTNEDLKRLVGLAHRRGMKIYLDIVVNHTADVIKNAEGTAYADKGTAPYRDTAGRPFEDRNYADGTHGFPKVDEKSFPHRPFFEKPSDATAKAPAWLNDPTMYHNRGETTFGGENAEYGDFTGGLDDLWTERPEVLHGLTDIYAGWIRRFGVDGYRLDTLKATDLAFWRPFAEGVGKAADKAGKRDFFLFGEAWSKDQEVTSTFVRRGGLPATLDFPFQGAAQSYARGQGTGQQPWQDLYAKDDLYSRRPGPTPAGCHLGEWNHDMGRIATLIKAGSDPKRGCRLELVNELMFLTRGQPGGLLRADEQGFTGRPRLNKGSRQDMFASRTPDYLDDRLIGTDKTHASDNHDTGHPLYRTIAELGAVRKAHPGLRDGEQITRYAADRAGVFAASRIDRDQRAEYVIAVNNATTAQTVTFDTYTPGCGFQPLYGTGETAATGADGRLTITVPALSAVAYRAEKPIPAADGAPAVTITAPAGRDPRAGPHRTDRAVTGDPLSTVTFSARAGNGPWQPIGTAGRGPYRVFHDLTGLAGGAEVQYRRSPGTPRPYRHHHQPDPVGTVRAEAGYAVVHYQRPAGDYDGWRLHATGERSKRPRSNPQGEPFTGNGTPNGPFAWVKLRPGATKVTFTVSDANGVKDVDADRSLNPQQTPGIWLHQGDPAISYQGPAPAPAPNTAILHYRRPAGDYTGWGLHLWDGAATPTADWGAPLLPESFDSFGAVFRIPLAAGATGLSYIMHAGEAKDLPTDQRLEFADAGREVWVQAGVQERLLPSVVKPAKLDLTRADAVRVDRDTIAWQTGTPDTLEPAGAATDGRVYDLVHAPNGGLRLVDGDLAGDYRSIRLTAQRDGLTEKQRRQAPELWQYPAFQAAAPCPPVTDSSM

SEQ ID NO: 12109 - protein, 335 aa, Thermotoga sp. RQ2
STFVAGLEKLRKGEVEPYGVPLARELPIDFKDIKIVGSYDVDRAKIGKKLSEVVKQYWNDVDSLTSDPEIRKGVHLGSVKNLPIEAEGLEDSMTLKEAIERLVDEWSKLDPDVIVNTCTTEAFKPFGNKEELLKAIENNDKERLTATQVYAYAATLYAKKRGGAAFVNVIPTYIANDPAFVELAKGNNLVVFGDDGATGATPFTADVLSHLAQRNRYVKDVAQFNIGGNMDFLALTDEGKNKSKEFTKSSIVKDILGYDAPHYIKSTGYLEPLGDKKFIAIHIEYTSFNGATDELMINGRINDSPALGGLLVDLLRLGKIALDRKEFGTVYPVNA

SEQ ID NO: 12110 - protein, 419 aa, Halymenia maculata
DTDILALFRVTPQPGVDPIEASAAVAGESSTATWTVVWTDLLTACDLYRAKAYKVDAVPNSSDQYFAYISYDIDLFEEGSIANLTASIIGNVFGFKAVKALRLEDMRIPVAYLKTFQGPATGTIVERERMDKFGRPFLGATVKPKLSLSGKNYGRVVYEGLKGGLDFLKDDENINSQPFMRWKERFLYSMEAVNRSIAATGEVKGHYMNVTAATIENMYERAEFAKQLGTVIIMIDLVVGYTAIQTMGIWARKNDMILHLHRAGNSTYSRQKSHGMNFRVICKWMRMAGVDHIHAGTVVGKLEGDPLMIRGFYNTLLLTHLDVNLPQGLFFEQDWASLRKVTPVASGGIHCGQMHQLLDYLGEDVVLQFGGGTIGHPDGIQAGATANRVALEAMVIARNEGRDYVAEGPQILQDARKTC

SEQ ID NO: 12111 - protein, 506 aa, Schizosaccharomyces pombe
MDLAPRPLGRQHSKSQSAFAFDNTATSIAASTMKNELNHLASTVKDPLAKKAFQKEMDNFFSLFSRYLQEDARGSEINWDLVESPKPEQVVEYDTITEAGGLSRDYLNKLAVLKLNGGLGTTMGCVGPKSIIEVRDGNSFLDLSVRQIEHLNRKYNVNVPFVLMNSFNTDEATAKVIKKYEAHKIDILTFNQSRYPRVHKETLLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 12112 - protein, 397 aa, Wolbachia endosymbiont of Drosophila melanogaster
MSDLAKRMSLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 12113 - protein, 534 aa, Nicotiana tabacum
FGLQNRRILQGSGDLKRNTLLASRSLRMPERSSCFGVSMDSASMGIELGRARKTVQSVFGSSAKARSHRVRASGGDIEDATPLKVQGQSSGSVLPYVGVACLGAILFGYHLGVVNGALEYLAKDLGIVENTVIQGWIVSSVLAGATVGSFTGGALADKFGRTKTFVLDAIPLAVGAFLCTTAQSVQAMIIGRLLTGIGIGISSAIVPLYISEISPTEIRGTLGTVNQLFICIGILVALVAGLPLSGNPLWWRTMFGIALIPSVLLALGMAFSPESPRWLFQQGRISEAETSIKRLYGKERVAEVMGDLEASAQGSSEPDAGWLDLFSSRYWKVVSIGAALFLFQQFAGINAVVYYSTAVFRSAGISSDVAASALVGAANVFGTMVASSLMDKQGRKSLLLVSFTGMAASMMLLSLSFTWKVLTPYSGTLAVLGTVLYVLSFSLGAGPVPALLLPEIFASRIRAKAVALSLGMHWISNFFIGLYFLSIVTKFGISTVYLGFASVCLLAVMYIVGNVVETKGRSLEDIERELSPAI

SEQ ID NO: 12114 - protein, 399 aa, Neurospora crassa
MGVEEKSRASGDSPRDAVLPTVNPEAQKAQPPKSAIHPAFYVSIWIAMSSSVILFNKWILSAKGFDFPVVLTTYHLAFSTIMTQILARYTTLLDGRKTVKMTGKVYLRAIVPIGFFFSLSLICGNLTYLYLSVSFIQMLKATTPVAVLLSGWALGVSQINMRVFLNVSVIVVGVVIASYGELEFVWLGVILQIAGVAFEALRLTMVQRLLSSAEFKMDPLVSLYYFAPICALMNGVVALFWEVPRLTMADVDRVGLFYFFLNGLCAFGLNVSVVFLIGKTSSLVLTLCGVLKDVLLVVASMVIYGSQVTLTQFFGYSIALGGMVYYKLGAETIKSYAGEAGRQWADFGNRRPVLRRISIILLSVFVVFSLLGGFAPNYAAGIDPTEYLNEAKSKIGMSA

SEQ ID NO: 12115 - protein, 397 aa, Zea mays
  unsure (1)..(397): unsure at all Xaa locations
MDGGGQPPDTEMTDAGAGGGGQPPPPAXPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPALRAAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEGDLDFVNENARRYIRQLPRHPRQSLPEKFPHVQPLAIDLVEKMLTFDPRQRITVEGALAHPYLASLHDISDEPGCSMPFSFDFEQHALSEEQMKDLIYQEALAFNPDYQ

SEQ ID NO: 12116 - protein, 909 aa, ASPERGILLUS NIDULANS FGSC A4
MPRSIPSYFTSAPPAEEHHDPENVSPGPRLNPRTAPPSPSVMRRTYSHLSESHTAYQSLEPPLEAGETTSLLGKAKEGGSGRMEPQRSYTTFSASSGPESGFRYTLLGSSLRRSRHHSRANSVHQRFSRRASMDEVPVESTAASIKDAMTSSFMDDRLWYDQFTSTDWVHDSVADGVRLRELRRRKDIRGRLLALFDGAQGWILVALIGCIVAAIAYFVDITEEYVFGLKNGICTTGWLRSRETCCADEEECPAWRSWSEMMNHHGGGSVSVDFGIYVLWSVILAAISCLLTLLTKTVVPSSVSLTTLDENLGANGSRQATEADGSPASVSGSSPYPPLPLRPDMVYYSAAGSGVAEVKVINSGFVLHGYLGFKTLVIKTLALIFSVASGLSLGKEGPYVHIATCVGNIACRLFSKYNLNDGKRREVLSASAASGVAVAFGAPIGGVLFSLEEVSYYFPPKTLFRTFFCCIAAALSLKFFNPYGTGKIVLFEVRYLGDWEIFELAIFMFLGVLGGAAGALFIKASSIWAKSFRRIPVIKRWPLFEVGLVALVTGLISFWNPYTKLPVTELLFQLASPCEHSTSDGLCPHPEGIGEVIRALTIAFVIKSFLTIVTFGIKVPAGIYVPSMVVGGLMGRIVGHVTQYLALQYPNFFLFGSSCAAGTGMESCVTPGVYAMVAAGATMCGVTRLSVTLAVILFELTGSLDHVLPFSLAVLCAKWTADAIEPHSIYDFLTEMNSYPFLDNKLQTVSDAVLGDIVRPIRRSRLIDITETPLVPARELRSKLQHLLMAGELDSGLPILRDGVLIGLIPAPDLEYALDNLEDEDRTSCLMATDTSSVVSDTDDEDTLQVDFTKYIDPAPLALDIHSPIDLVYQCFVKLGLRYLCVLHDGQYAGLVHKKAFVKFMKEQH

SEQ ID NO: 12117 - protein, 572 aa, Streptomyces clavuligerus
  unsure (1)..(572): unsure at all Xaa locations
SRVSTAPSGKPTAAHALLSRLRDHGVGKVFGVVGREAASILFDEVEGIDFVLTRHEFTAGVAADVLARITGRPQACWATLGPGXTNLSTGIATSVLDRSPVIALAAQSESHDIFPNDTHQCLDSVAIVAPXSKYAVELQRPHEITDLVDSAVNAAXTEPVGPSFISLPVDLLGSSEGIDTTVPNPPANTPAKPVGVVADGWQKAADQAAALLAEAKHPVLVVGAAAIRSGAVPAIRALAERLNIPVITTYIAKGVLPVGHELNYGAVTGYXDGILNFPALQTXFAPVDLVLTVGYDYAEDLRPSXWQKGIEKKTVRISPTVNPIPRVYRPDVDVVTDVLAFVEHFETATASFGAKQRHDIEPLRARIAEFLADPETYEDGXRVHQVIDSXNTVXEEAAEPGEGTIVSDIGFFRHYGVLFARADQPFGFLTSAGCSSFGYGIPAAIGAQXARPDQPTFLIAGDGGFHSNSSDLETIARLNLPIVTVVVNNDTNGLIELYQNIGHHRSHDPAVKFGGVDFVALAEANGVDATRATNREELLAALRKGAELGRPFLIEVPVNYDFQPGGFGALSI

SEQ ID NO: 12118 - protein, 292 aa, Tropheryma whipplei str. Twist
MKGIILAGGTGSRLWPITKCISKQLMPVYDKPMIYYPLSTLMMADIREILVITTTQDYDQFRRLLGDGGQWGIKLSYAQQLSPGGLAQAFLIGESFIASESIALVLGDNIFHGSGLGTSLRQHRSIQGALIFAYHVSNPKDYGVVTFDADGKAVSIEEKPESPKSNFAVPGLYFYDNQVVDIAKQIPLSARGELEISSVNNFYLEKDQLRVYPLARGTSWLDTGTFDSLVQASEYVRVIEQRQGFKVGCVEEIAWRAGWIDDDQLAKLANGLMKSGYGKYLHYLLSGKHGFS

SEQ ID NO: 12119 - protein, 429 aa, Arabidopsis thaliana
MVNSCENKIFVKPTSTTILQDETRSRKFGQEMKREKRRVLRVINQNLAGARVYPCVVNKRGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLINETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 12120 - protein, 496 aa, Triticum aestivum
  unsure (1)..(496): unsure at all Xaa locations
MDPYKYRPSSSFNAPMWSTNSGAPVWNNDNSLTVGXSRGPILLEDYHLVEKIADFDRERIPERVVHAXRGASAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDIGVPADYRHMDGSGVNTYTLVNRAGKAHYVKFHWKPTCGVKSLLEDEAVTVGGTNHSHATKDLTDSIAAGNYPEWTFYIQTIDPDHEERFDFDPLDVTKTWPEDVVPLQPVGRLVLNRNIDNFFAENEQLAFCPGXSSSPGCTTRTTSCCRRGSSPTRTRSATGWGPNYLLLPANAPKCSHHNNHYDGLMNFMHRDEEVDYFPSRFDPAKHAPRYPIPSRTLNGRREKMVIEKENNFKQXPGERYRSMDPARQERFINRWIDALSDPRLTHEIKAIWLSYWSQADKSLGQKLASRLSSKPSM

SEQ ID NO: 12121 - protein, 300 aa, Symbiodinium sp. P083-2
RIGRQVARIAMKDPETDLKLINASYDADYLAYMMKYDTIHGKYDGTVEVDGDSLVIDGQTVALSHTRDPAEIPFKEHGAEYVCESTGVFLTTDKVQPHLKAGAKKVIFSAPAKDDSHTIVMGVNEDTYDPSMECVSCASCTTNGLAPAVRVLQEKFGIKRGLMTTCHAMTASQPTVDGTSKKDWRGGRAGPGNIIPSSTGAAKAVAKVLPAVKGKLTGMALRVPTIDVSVVDLTCELEKETTYEEICAEMKKRSEGDMKGYLGYTDEALVSTDFETNPISCTFDSKAGIMLDPTFVKEVC

SEQ ID NO: 12122 - protein, 633 aa, Saccharomyces cerevisiae
MLSKVLLNIAFKVLLTTAKRAVDPDDDDELLPSPDLPGSDDPIAGDPDVDLNPVTEEMFSSWALFIMLLLLISALWSSYYLTQKRIRAVHETVLSIFYGMVIGLIIRMSPGHYIQDTVTFNSSYFFNVLLPPIILNSGYELNQVNFFNNMLSILIFAIPGTFISAVVIGIILYIWTFLGLESIDISFADAMSVGATLSATDPVTILSIFNAYKVDPKLYTIIFGESLLNDAISIVMFETCQKFHGQPATFSSVFEGAGLFLMTFSVSLLIGVLIGILVALLLKHTHIRRYPQIESCLILLIAYESYFFSNGCHMSGIVSLLFCGITLKHYAYYNMSRRSQITIKYIFQLLARLSENFIFIYLGLELFTEVELVYKPLLIIVAAISICVARWCAVFPLSQFVNWIYRVKTIRSMSGITGENISVPDEIPYNYQMMTFWAGLRGAVGVALALGIQGEYKFTLLATVLVVVVLTVIIFGGTTAGMLEVLNIKTGCISEEDTSDDEFDIEAPRAINLLNGSSIQTDLGPYSDNNSPDISIDQFAVSSNKNLPNNISTTGGNTFGGLNETENTSPNPARSSMDKRNLRDKLGTIFNSDSQWFQNFDEQVLKPVFLDNVSPSLQDSATQSPADFSSQNH

SEQ ID NO: 12123 - protein, 217 aa, Chloroflexus aurantiacus
MQIYLDTANLAEIREAASWGILSGVTTNPTLIAREKGADFKAIITEIAELVDGPISAETISLDAEGMVREGLEYASWHPNVIIKVPSTTEGLRAVSQLAKHGIRCNVTLCFNSVQALLAARAGAFIISPFVGRVDDTGVDGMALIREIAGIYRQDREITTKILAASIRHPRHIVEAALAGADIATCPFKVLQQAMRHPLTDRGIEQFLADWKSRMSS

SEQ ID NO: 12124 - protein, 194 aa, Buchnera aphidicola
MSEILLIDNLDSFTYNLVDIFKKNKYKVFIFRNYISKKIIEKKIVNMKNPILVFSPGPGLPKNAGCMNSLIKTFESKIPIIGICLGFQAIIEIFGGSIIQSKKIYHGKISIINHDGLDIYKNIKNPLQVGRYHSFVCNKVPNNFIANSFCKKIVMSIKNKSKKIFGFQYHPESILTPYGDKILLNTISWIENKI

SEQ ID NO: 12125 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGTAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 12126 - protein, 98 aa, Papaver rhoeas
TNVFAYPGGASMEIHQALTRSSSIRNVLPRHEQGGIFSAEGYARASGLPGVCIATSGPGATNLVSGLADALLDSIPIVAVTGQVHRRMIGTDAFQETP

SEQ ID NO: 12127 - protein, 429 aa, Methylobacterium extorquens
MTAITNIAAREILDSRGNPTVEVDVLLEDGSFGRAAVPSGASTGAHEAVELRDGDKSRYNGKGVLKAVDAVQSEILDAIGGMDAEDQVAVDEAMIALDGTPNKARLGANAILGVSLAVAKAAAETAGLPLYRYVGGVQGRVLPVPMMNIVNGGAHADNPIDFQEFMVMPVGATSLSDAVRMGAEIFHTLKSALKKAGHNTNVGDEGGFAPNLPSAEAALDFVMESINAAGFKPGSDVVLALDCAATEFFKDGAYRYEGEGQTRSIEQQVDYLAKLTEAYPILSIEDGMSEDDWEGWKLLTDRIGSRVQLVGDDLFVTNVERLARGIETGTANSILVKVNQIGSLTETLAAVDMAQRAGYTAVMSHRSGETEDSTIADLAVATNCGQIKTGSLARSDRLAKYNQLIRIEEGLGAQALYAGRSAIRQLAGR

SEQ ID NO: 12128 - protein, 281 aa, Nitrosomonas europaea ATCC 19718
MQSQKKFTPTFSFEFFPPQTPEGMEKLRATRIQLAQFNPKFFSVTFGAGGSTRERTLETVLEIQAEGYPVAPHLSCIGSTRDNIRSILEKYHSHGISRIVALRGDLPSGMAQAGEFRYANELVAFIRKEFGDTFWIEVAAYPEYHPQARSALEDFTNFRRKVEAGSNAAITQFFYNVDAYLHFVEMCEAADLNIPIVPGIMPISKFSQLARFSDGCGAEIPRWIRRKLESFGDDIPSIQAFGLDVVTALCARLLEAGAPGLHFYTLNSAVLPTKIWQRLGL

SEQ ID NO: 12129 - protein, 226 aa, Caulobacter crescentus CB15
MARYPRAMTAPIIAPSILASDFAKLGEEVAAIEAAGADWVHVDVMDGHFVPNITLGPDIVKAIRPHAKIPFDVHLMISPADPYLEAFRAAGADLISIHPEAGPHLHRSLKRIRELGAKAGVVFNPSTGIDHVEWILEDVDLLLVMSVNPGFGGQSFIPGQLRKVEALRKMVDKAGLDIIIEVDGGVTPVTAPQCVAAGATALVAGSAVFKGGPAAYADNIRALKGG

SEQ ID NO: 12130 - protein, 393 aa, Prochlorococcus marinus subsp. marinus str. CCMP1375
MSNLDVISERALSLKPSLTLEISSLAQSLKQKGRDICSLSAGEPDFDTPNFIVEAAKKALDDGITKYGPAGGDPSLREEVAKKLTEINDVPTSPENVLITNGGKQAIFNLLQVIINPGDEVLIPSPYWLSYPEITKIAGGIPITINSSKGNSFSLDIEEIEKNINHKTKLLILNSPCNPTGRIIQESELQSIANLLRKHPNIYVMSDEIYEFLITDKEVHISLASIAPDLKDKIFIVNGFAKAWAMTGWRVGYLQGSSKIIKKAIALQSQSTSNVCSFAQRGALAAIKGAPKGIDYMIQSYNERRKLLTEELRQISSLSLEAQSGAFYAFPKLSDELPDSLSFCKIALEKEGLAIVPGIAFGNDRCIRLSCSVNTETLNDGITRLNRIIKDIT

SEQ ID NO: 12131 - protein, 288 aa, Zea mays
MSASEVNGSKLSPEELVVLQGCPCPPSRLRPGFYWYDKVSGFWGKEGHKPHCIITANLNVGGSLDQKASNGNTGILINGREITKSELQMLKLAGVQCAGKPHFWVNADGTYQEEGQKTVKGKIWDKPIVKLLSPVLSLPTPNKAANQSSEDAVDIVNRAIPDYLEQRTTQKLLLVGSGASTILKQAKFLYKTGKPFSVDEREDLKLIIQSNIYNYLGILLEGRERFEEESLADRRKTSQCDPSSSGCCEPGLSDEVTEYSLIPRLKAFSDWILKAMALGNLEDIFPAA

SEQ ID NO: 12132 - protein, 178 aa, Zea mays; identical to SEQ ID NO: 1586

SEQ ID NO: 12133 - protein, 647 aa, Azotobacter vinelandii
MGEITFASGRQLDVICLGRLGVDLYAQQIGARLEDVGSFAKYLGGSSANIAFGTARLGLKSAMLTRVGDDHMGRFLIEALEREGCDTRAIKVDPERLTAMVLLGIKDRDTFPLIFYRENCADMALREEDIDEAFIASSKALLITGTHFSTERVYKASSKALDYAEKHNVKRVLDIDYRPVLWGLTGKADGETRFIASAEVSAHVQRILPRFDLVVGTEEEFLIAGGSEDLLSALRKVREVTAATLVVKLGPLGCTVIHGAIPARLEDGNIYKGIRVEVMNVLGAGDAFMSGFLRGWLTGGDDERCSRLANACGGLVVSRHACAPAMPTPAELDYILNSPVPITRPDLDPHLNRLHRVSVPRKNWKPLFIFAFDHRGQLVELAQQAGRDLAAIPELKQLFITAIERVEADLQRQGIEGDVGLLADQRFGQDALNSATGRGWWIGRPVELQGSRPLAFEHGRSIGSNLVQWPREHIIKCLVQFHPDDEPLLRLEQEGQLKGLYEAAQASGHELLLEVIPPKNHPSTHPDVLYRAIKRLYNIGIHPDWWKIEPQPAEVYSKLDALITERDPYCHGVVLLGLNAPAEELAEGFRQAAGSQVCRGFAVGRTIFQEPSRAWLAGEIDDETLIARVRATFEFLIKSWREARGQV

SEQ ID NO: 12134 - protein, 306 aa, Magnetospirillum magnetotacticum
MPSTSRHRASRDGFRPIRVSIEFFPPKTEEMEKILWSSIERLAPLQPKFVSVTYGAGGSTRERTHNTVARMVRETTLKPAAHLTCVDATKEEIDAVVQSYWEAGVRHIVALRGDPAEGVGHAYRPHPGGYATTADLVAGIKRIGDFKVSVSAYPEKHPEAASLDADIDVLKAKVDAGADQAITQFFFDNEIYLRYRDKVRAAGIDVPIIPGILPVQNFKQAANFARRTGASVPYWLAARFEGLDNDVETRRLVAAAVAAEQVLDLVDEGVEDFHFYSMNRSDLVYAICHLLGLRSQAPAKPAAKAA

SEQ ID NO: 12135 - protein, 409 aa, Photobacterium profundum
MELTTTVTELRYALDTFFFLISGALVMWMAAGFAMLEAGLVRSKNTTEILTKNFCLYAIACTTYLIVGYNIMYVDNGEGGWLPSIGALIGTQAEGADHSLESDFFFQVVFVATAMSVVSGAVAERMKLWSFLLFSVVLTAFIYPMEGYWTWGGGFLSEAGFSDFAGSGIVHMAGASAALAGVLLLGARKGKYGKNGEINPIPGSNMPLATLGTFILWLGWFGFNGGSQLMLSDFENASAVGQIFLNTNAAAAAGAVAALAVCKTMWGKADLTMILNGALAGLVAITADPLSPSPIASVIVGVVAGALVIFSIIMLDKIKIDDPVGAISVHGVCGFFGLMVVPFSNGDASFGAQLLGAAVIFAWVFTASFVVWFVIKVTIGIRVTEEEEMAGMDLHDCGVDAYPEFVSLK

SEQ ID NO: 12136 - protein, 292 aa, Glycine max
SIFANFLYRSWLIDIGGFAKKVKSTTLSSADQIKDCGAYRECPNCSYHIDNSDVSTEWPGFPLGVKFDPSDVELLEHLAAKCGIGNTQQHMFINEFIPTLEGDQGICYTHPENLPGAKKDGSYVHFFHRTANAYATGPRKRRKIHHQDGMTEEHVRWHKTGRTKAVIEDGVHKGFKKIMVLYIRSKKGSKPYKTNWVMHQYHLGSEEDEKDDEYVVSKIFYQRQKQSEKNEENTVVEDSNIAAQAGPRTPKPNPPTRPCTGKCDDNFDENELLSFIQDAKPIPGESLAPPYD

SEQ ID NO: 12137 - protein, 425 aa, Methanosarcina mazei Goe1
MEFKQGDRVRIEKNGTVYEGKVMPSMEGYITIKMKSGYNAGFSIDKVSITPLENNGEAANGGNGGKNGQKEPEPAKEKVSKPGLPKVSILSTGGTIASKIDYRTGAVTSQFTADDILAAIPELKEIADFKGRAISSILSENMDPDSWQNLARAVVEEIEAGADGIIVTHGTDTMMYSAAALSFMIETPVPIVFVGSQRSADRPSSDNAMNAICAARVAISDIAEVVVVMHGTSSDDYCEIHRGTKVRKMHTSRRDAFKSVNSLPIGTVDYDTGEIKTFIEYTGRGEKSLKFKPGMEPKCAIVKFTPGADPSVLDCYVDGGYKGLVLEGTGLGHVSTKWIPFIRRAVDAKMPVIVTSQCLNGRVCDRVYDTGRDMLKAGAIEGEDTLPETALVKLMWVLGQTDEFEKAVSMLGENLSGEINECTLR

SEQ ID NO: 12138 - protein, 135 aa, Salmonella enterica
GDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 12139 - protein, 760 aa, Luffa cylindrica
MWKLKVSKGWETSENDHVGRQYWEFDPNLEPSEEERAEIENVCNEFHKNRFHVKQSSDLLMRLQLRKENASNVKLLTQIKVASEEEISEEAVETTLRRAIRFYSTMQTQDGFWPGDYGGPLFLLPGLVIGLSVTNALNVALSCNHRQQMCRYLYNHQNEDGGWGLHIEGNSTMLCTALSYVSLRLMGEEMDGHDGALPKARRWILDRGGATSIPSWGKIWLSVLGVYEWEGNNPLLPEIWLLPYNILPFHPGRMWCHSRMVYLPMSYLYGKRFVGSISPIVMSLRRELYKCPYHMVDWNSSRNLCAKEDLYTPHSKIQDMLWDSINKFGEPFMKKWPLSKLRQRALDLVIQHIHYEDENTHYLCLGPVNKVLNMVCCWVEDQNSEAFRRHISRIKDYLWLAEDGMKMQGYNGSQLWDVAFAVQAVVAADLVEEYGSVLKKAHDFVKNSQVRRNGLGDSSDWYRHISKGGWPFSTPDNGWPVSDCTSEALKVAILLSKMPSTMVGEPIDVDKLYDAVNLILSLQNPNGGFASYELTRSYPWLEMFNPAEIFGDVMIDYQYVECTSAAIQGLKAFMQLHPGHRKKEIQKCIAKAANFIESIQQTDGSWYGSWGICYTYGTWFGIKGLVACGRTYDNSKSIRKATEFLLSKQLKSGGWGESYLSAHHKVYTNLKGCKSHIVNTSWALLALIKAGQAQRDLTPLHRAAMVLINSQLHDGDFPQQEIMGVFNKSCMISYSAYRNIFPIWALGEYRIRVLQLHEKF

SEQ ID NO: 12140 - protein, 523 aa, Candida maltosa
MAIEQIIEEVLPYLTKWYTILFGAAVTYFLSIALRNKFYEYKLKCENPVYFEDAGLFGIPALIDIIKVRKAGQLADYTDTTFDKYPNLSSYMTVAGVLKIVFTVDPENIKAVLATQFNDFALGARHAHFDPLLGDGIFTLDGEGWKLSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 12141 - protein, 262 aa, Neurospora crassa
MGHEDAVYLAKLAEQAERYEEMVENMKIVASEDRDLTVEERNLLSVAYKNVIGARRASWRIVTSIEQKEESKGNSTQVSLIKEYRQKIESELAKICEDILSVLDQHLIPSATTGESKVFYHKMKGDYHRYLAEFAVGDKRKDSADKSLDAYKNATDVAQTELPPTHPIRLGLALNFSVFYYEILNAPDQACHLAKQAFDDAIAELDTLSEESYKDSTLIMQLLRDNLTLWTSSEAEAPAAQGEAAPEEPKADAPAAEEPKAE

SEQ ID NO: 12142 - protein, 266 aa, Triticum aestivum
SAHASVGYMLSDMLKENNGNKEGLLFDTHARTALAFVTLRSDGEREFMFYRNPSADMLLEEKELDLDLIRKAKIFHHGSINLITEPCKTAHIAASKAAKDAGVLISYDPNLRLPLWTSADDARDGILSIWDTADLIKVSAEEISFLTNGEDPYDDSVVKKLIHPNTKLLLVTEGPDGCRYYSKEFSGKVGGLKVTAVDTTGAGDAFVAGILSQLAADFSLLQDEARLREALKFANICGALTVTERGAIPALPTRQQVADALTNVVA

SEQ ID NO: 12143 - protein, 147 aa, Triticum aestivum
PIASIEDAFDQDDWENWAHLLETSEFQLVGDDLTVTNPLRIATAIEKKACNALLLKVNQIGTVTESIQAALDSQAAGWGVMVSHRSGETEDTTIADLVVGLRTGQIKTGAPCRSERLAKLNQLLRIEEELGSSAIYAGENFRKAHEL

SEQ ID NO: 12144 - protein, 398 aa, Triticum aestivum
  unsure (1)..(398): unsure at all Xaa locations
MEVLKAEASAKVHKFTEWALKCIGLHARVRESRGKGNHGTIIEVQLQLSAFKTFLDIADNDLTGKDFTEAFDAACFPLTLFSSTFDQGWAAGISAAAIQGLLELLVEGGADNVNQCFLEAARYGSTELVRILLQIAQRNSLDIDVDLALGFAAHYGKLETMGCLVEEGNTVAFLGPLMRAAERGCFQVVEWFVNRGCRDMELCLALTAATSSSQVEVAAYLLPLVPQLVLAPLSIEIVKAAGERSTGSLQGVDFLLRSDFLNDPAATYAVADSIARCADEAVDAKLRLFMLEQWSEEAFNKGFRXSQEHFVNITRIMQRGESPVVLRQLPLQLVIAMAYLPLYRECVGSGGRLLPQRLRGQLVEAAGRLEGRQLDRGMQQSELLAILEHHLPRFLVQT

SEQ ID NO: 12145 - protein, 188 aa, Neisseria meningitidis serogroup A
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 12146 - protein, 186 aa, Zea mays
MAPSTALAPVAFRSAFSTPLASKPTRNRMNIEGAFCLPCSTRKRASYRPFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 12147 - protein, 474 aa, Grateloupia turuturu
RYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDMNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPLQTALDLWKDITFNYTSTDTADFVETPTTNV

SEQ ID NO: 12148 - protein, 128 aa, Zea mays
  unsure (1)..(128): unsure at all Xaa locations
MADPELEAIRQRRMQELMAQHGVXXQQXXEQQKAQEDAKMEAEERRQMMLSQILSAEARERLAXIALVKPEKARGVXDVILRAAQMGQITEKVSEERLITLLEQINNQTTRQTKVTIQRRRSVLEDDD

SEQ ID NO: 12149 - protein, 579 aa, Chlamydomonas reinhardtii
MASPAPSGSPPLVIYSCTDEQMLEVTELVGDSATAAIVCSQYDCSFTAVSCVLKYLAAQQADLSEQMDGTAKAEVALSLDVAFLLFSAYLVFGPMQLGFALLCAGAIRSKNSMNVLMKNILDACTGAIGFYLFGYAFAFGHHANQTSNAFIGDHNFALSYTTQVSSLDSNVSYDGFATQGWHVFFFQWSFCAAATTIVSGAVAERCTFQAYLAYAFFISSFVYPVVVHWVWSASGWLSAFNTSRDGYALLLQTGAIDFAGGGVVHLTGGMAALMGAWIIGPRIGRFDASGKVNEMKGHSATLVVMGTFLLWFGFYGFNPGSNLTIATTASAIVVSRVAVTTTLSAGAAGLTGLFWRYMRTSTWDTVLVCNCCLAGLVGITCSCSVVEPWAALICGFVAAFVFIGFEYVVLYKMKIDDPVSAVALHLFCGVWGLLFPGLLAQPTYVADVYGAYGFGPDVKGSKKFGILYGGHGQVLLCQVIEALSICAWVGVMMGAFFGLLKVAKRLRVPVDQELAGLDVSKHTKEAYNGAIMPTAGGGAGGGGGYGSNGGERGSGFYTGAGPAGDTSTGGGHAANGGYD

SEQ ID NO: 12150 - protein, 152 aa, Zea mays
MISAKKIAHLAKKWQRMAAQGRKRLALGAAAKQADECCSYVASKGHCAVYTADGARFEVPLACLSTPVFGELLQMSQEEFGFTGGDGRITLPCDAAIMEYAMCLLRRGASAELEQAFLSTMAMSCHCASHMAPYVGRAHEPDSRLLFSFCSV

SEQ ID NO: 12151 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 12152 - protein, 301 aa, Arabidopsis thaliana
PSVSFQLPVIDFSDQNLKPGSSKWDEVTADVLKALEDYGCFEASFDKLSVELNRSVFEAMEDLFELPIPTKQRNVSSKLFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGR

SEQ ID NO: 12153 - protein, 527 aa, Solanum tuberosum
MAVEDNNLQVLNALDLAKTQLYHFTAIIIAGMGFFTDAYDLFSISLVTKLLGRLYYTKPDLLKPGTLPPARVGLRHGCALVGTLAGQLFFGCARLAKMGRKKVYGMTLVLMVVCSVASGLSLGNTPKVVMTTLCFFRFWLGFGIGGDYPLSATIMSEYANKKTRGAFIAAVFAMQGFGILFSGIVALITAAGFDHAYKAPTFAENAAVSTVPQADYIWRIILMFGSLPAALTYYWRMKMPETARYTALVAKDAKRAAQDMGRVLQVEIESEEAKIEQISRDETNQFGLFSWEFVRRHGLHLFGTCSTWFLLDIAFYSQNLFQKDVFSAVGWIPKAPTMNAVQELYKIARAQTLIALCSTVPGYWFTVAFIDIIGRFAIQLMGFFFMTVFMFAIAIPYHHWTLEANRIGFIVMYSLTFFFANFGPNATTFVVPAEIFPARLRSTCHGISAAAGKAGAIVGAYGFLYAAQSKDPMKTDAGYPAGIGIKNSLIVLGFINALGMVCTFCVPESKGKSLEEASQETISTGEA

SEQ ID NO: 12154 - protein, 170 aa, Zea mays; identical to SEQ ID NO: 3644

SEQ ID NO: 12155 - protein, 486 aa, Arabidopsis thaliana
MESVALSRIGLAGLAVMGQNLALNIADKGFPISVYNRTTPKVDETLDRASNEGKLPVAGQYSPRDFVLSIQRPRSVIILVKAGAPVDQTITALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNTNLASLVVDPDFAKEMVQRQAAWRRVVGLAISAGISTPGMCASLAYFDTYRRARLPANLQAQRDLFGAHTYERTDRPGAYHTEWTKLARKSQ

SEQ ID NO: 12156 - protein, 173 aa, Triticum aestivum
  unsure (1)..(173): unsure at all Xaa locations
MGRKFFVGGNWKCNGTVEQVESIVNTLNAGQIASTDVVEVVVSPPYVFLPTVKGXKLRPEIQXVAAQNCWVKKGGAFTXGEVSAEMLVNLGVPWVIXLGHSERRSLMGESSXFVGEKVAYALAQGLEGNXCVGEXLEQREAGLTMAVVAEQTKQCDKXKDWTTGLANNGNTVN

SEQ ID NO: 12157 - protein, 375 aa, Populus x canescens
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 12158 - protein, 203 aa, Fusobacterium nucleatum subsp. nucleatum ATCC 25586
MFLMIDNYDSFVYNLVSYFLEENIEMKIIRNDLVDLKYIENLIEKGKLEGIIISPGPKSPKDCGLCNEIVKQFYKKVAIFGVCLGHQIIGHVFGAEVKKGKSPVHGKVHKIRNSGENIFKSLPKEFNVTRYHSLVVEKEKLLNDFNIEAETDDGVLMALSNKNYPLYSVQFHPEAVLTEYGHEMIRNFLDLAKEWRDKNANRS

SEQ ID NO: 12159 - protein, 767 aa, Arabidopsis thaliana
MWRLKIGAKGGDETHLFTTNNYTGRQTWEFDADACSPEELAEVDEARQNFSINRSRFKISADLLWRMQFLREKKFEQKIPRVEIGDAENITYKDAKTALRRGILYFKALQAEDGHWPAENSGCLFFEAPFVICLYITGHLEKILTLEHRKELLRYMYNHQNEDGGWGIHVEGQSAMFCTVINYICLRILGVEADLDDIKGSGCARARKWILDHGGATYTPLIGKAWLSILGVYDWSGCKPIPPEVWMLPTFSPFNGGTLWIYFRDIFMGVSYLYGKKFVATPTPLILQLREELYPQPYDKILWSQARNQCAKEDLYYPQSFLQEMFWKCVHILSENILNRWPCNKLIRQKALRTTMELLHYQDEASRYFTGGCVPKPFHMLACWVEDPDGDYFKKHLARVPDYIWIGEDGLKIQSFGSQLWDTAFSLQVMLAYQDVDDDDDEIRSTLIKGYSFLNKSQLTQNPPGDHRKMLKDIAKGGWTFSDQDQGWPVSDCTAESLECCLVFGSMPSELIGEKMDVERLYDAVNLLLYFQSKNGGITVWEAARGRTWLEWLSPVEFMEDTIVEHEYVECTGSAIVALARFLKEFPEHRREEVEKFIKNAVKYIESFQMPDGSWYGNWGVCFMYGTFFAVRGLVAAGKTYQNCEPIRKAVQFILETQNVEGGWGESYLSCPNKKYTLLEGNRTNVVNTGQALMVLIMGGQMERDPLPVHRAAKVLINSQLDNGDFPQEEIMGVFKMNVMVHYATYRNIFTLWALTYYTKALRVPLC

SEQ ID NO: 12160 - protein, 622 aa, Oryza sativa
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICLAINLLVPLRMPDDKLEVGDDAVHGEEAYALWGDGEMYDVTKHGSDAAVAPVVLNTDLSFAAHKQQSDRGEAPLRSFANLAMKPWTATVSLLLAAAVAMAAAVAAGEGGAANYLVFVDPPPSGVVCTAYQLSILAAALGSEEKAKGAIIYNYKNVVSGFSARLTPSELEAVKKQPQVNRVLPSATLSLMSSNFDGIS

SEQ ID NO: 12161 - protein, 579 aa, Schizosaccharomyces pombe
MSAKDYDFDIESVLPEEKAPQVSEAKKDYISQESTVLSGQVDFVEPEHKGFFQNLIDGFKPAREADGNGGPALKRGLSTRHMQLMSIGGAIGSGLYVGSGSALADGGPASVIINYILIGIMMFFVIYALGEMAVAYPVAGSFNTYATRFIDPAWGFAVSWNYFFNYFVTFPFELTTCAITFTFWTDVNCAVWISIFLVVVIGINLFGVRVFGEVEFVLALIKVVATVGFIILAIIINCGGVPTDHRGYIGGSIIKQKPFRHGFKGFCSVYTTAAFSFSGTEIVGLAAAEVGDPRKTLPGAVKQVFWRVAIFYIVSLILIGLLISPDDPKLMGNGSASVSPFVLAIQEANIKGLPSVFNAVIIISVISVTNSSTYTAGRTLHGMANLKQAPAFFKYTDRLGRPLIAMIVVLSFGFFAYINEANNNGNDISDTVFDWLLAISGLSNFFTWGSICLSHIMFRLAFKKQGHSLKELGFVSPMGIWGSVIGLGFNILCLMAEFYVSLFPIGGSPNANDFFQGYLAACITLVFFIGYKIYDRSHIPSLDKLDITTGLKTYEYEETKDSSDTGRFRFFKKIINTVC

SEQ ID NO: 12162 - protein, 316 aa, Zea mays
  unsure (1)..(316): unsure at all Xaa locations
MSGDRSPTVERRRGIRRLLLHPRGEASSSSPPPXPAPAPEEGRRKGFATAALRGLGCTSASASQAYAPGEAAAAAAVRSSADWQGRRRRRGRDRRKERGGGGGGGVGFVTGGIGAEVWCAPGIPFAAEASSVKFYNVTQVESLPCSAVLMSSXPDPQRPCLSRRVTVQEQISSSFMDSPPPHLDAPLFGADLIPSGRLRRMRGWRHSPGGLEEEIRMFQTRVLLGGMNMYDRYQDWRLDVDNMTYEELLELGDKIGYVNTGLRDDEITRNLRKKNFETNEEMGRLDCGHSYHVYCIKQWLSQKNICPVCKTAVSKN

SEQ ID NO: 12163 - protein, 424 aa, Zea mays
  unsure (1)..(424): unsure at all Xaa locations
TPSIDIQTLALFKRVCVCLSLASAHPHLHQRPGGTSTAEANRDGRRPAAAHPTPRLLLLLLPGSREAVCCWEAAPAPAPSEAEKKPPAVSGVGPWAMNAAPCLSLILVPRQLMSSSGYAAASATTLTGCHFTVRAFVAWTSDATSYSASKDVSLWELVWXSLVAHTCISGHEPQLHVHLHSDRCQIFQRHMTPAVRLMXWVLTSKHSPTSAKTSVTREAASAXTCNSAAESAKAQKLSCACVAVSCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 12164 - protein, 157 aa, Zea mays
MAAAATATPSVAPEAGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 12165 - protein, 457 aa, Sphacelaria rigidula
  unsure (1)..(457): unsure at all Xaa locations
DYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATGLVVERERLDKFGRPFLGATVKPKLGLSGKNYGRVVYEGLRGGLDFLKDDENINSQPFMRWKERFLYCMEGVNRAAAATGEVKGSYLNITAATIENMYERAXFAESXGTVICMIDLVIGYTAIQTMAIWARKAQLILHLHRAGNSTYARQKNHGINFRVICKWMRMCGVDHIHAGTVVGKLEGDPLMVXGSYNTLLLXELKVNLXEGXXFDMDWXSLRKCVPVASGGIHCGQMHQLLYYLGDDVVLQFGGGTIGHPDGIQSGATANRVALEAMVLARNEDRDYVSEGREILRAAASTCGPLKAALDLWKDITFEYTSTDTPDFVEVATGSK

SEQ ID NO: 12166 - protein, 472 aa, Gymnogongrus sp. FredericqS_19.i.95_1
ESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVCERERMDKFGRPFLGATVKPKLGLSGKNYGRVVYEGLKGGLDFLKDDENINSQPFMRWKERYLYSMEGVNRATAASGETKGHYLNVTAATMEEMYERAEFAKQLGSIIIMIDLVIGYTAIQTMAIWSRKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 12167 - protein, 337 aa, Cochliobolus lunatus
MVVKVGINGFGRIGRIVFRNAIEHNDVEIVAVNDPFIEPHYAAYMLKYDSTHGQFKGDIKVDGNNLTVNGKTVRFHMEKDPANIPWSETGAYYVVESTGVFTTTEKAKAHLKGGAKKVVISAPSADAPMFVMGVNHETYKSDIEVLSNSSCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGPLSGILGYTEDDIVTTDLNGDNRSSIFDAKAGISLNKNFVKLVSWYDNEWGYSRRVLDLLVYIAKIDGNA

SEQ ID NO: 12168 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 12169 - protein, 330 aa, Glycine max
  unsure (1)..(330): unsure at all Xaa locations
MLSSHSPPPPPPSFSTTTSTTTTTFTSSPCPRRIYLNNPTQIPKPYPYTHLFTHHSSLLNNYFTNMNPSCRFSSTKHTPFLHNSKPTSPFFLRHSHSHSHQVKPFPLSPPITTTTAKPYPLNILRLRNIKLSHPLATLSSFAEGEEENQKEGAESPPNNDELGGIAKAFNISSRTASAISICMALAVLTFPLFMTSLGQGMALKTKVLSYATLLFGFYMAWNIGANDVANAMGTSVGSXGALTLRQAXVLTAAVLEFSGALMMGTHVTSTMQKGILVANVFNGKDSLLFAGLLSSLAAAGTWLQFASYYGWPVSTTHCIVGAMVGFGLAY

SEQ ID NO: 12170 - protein, 792 aa, Oryza sativa (japonica cultivar-group)
MEKDHQPVISLRPGGGGGGPRPGRLFSPAFAAAASGSGDLLRSHVGGASKIGDPNFEVRERVRYTRDQLLELREIVDIPEAILIKQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPWSARRGNLSEKDRVLKTVKGILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAIKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASPTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHTKKIFKTEDLKTGCLLYAALLEDIGIDLPLAPALFGEVVARLSLSCSLSFEVVEEILKAVEDTYFRKGIFDAVMKTMGGNSSGQAILSSHAVVIDACNKLLK

SEQ ID NO: 12171 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEVARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 12172 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPENGGPRICLGQQFALTEASYVTVRLLQEFGNLKQDPNTEYPPKLQNTLTLSLFEGAEVQMYLIL

SEQ ID NO: 12173 - protein, 391 aa, Streptococcus thermophilus
MAERILMTNGKLKVTDNPIIPFIEGDGVGRDIWKNAQAIFDKAVEAAYEGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVIAFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTVDLAFGKRAYSTSGFSNQILSII

SEQ ID NO: 12174 - protein, 221 aa, Glycine max
MSNVFEGYERQYCELSANLAKKCTAAGALNGEQKKQKVSEVKAGIDEAEALIRKMDLEARSLQPNIKGVLLAKLREYKSDLNNLKSEVKKIVSGNLNPSARDELLESGMADAMTASADQRTRLMVSTERLNKTSDRVKDSRRTMLETEELGVSILQDLHSQRQSLLHAHNTLHGVDDNIGKSKKILTNMSRRMNKNKWVIGGIVLVLVIAIIVILYFKFSK

SEQ ID NO: 12175 - protein, 431 aa, SYNECHOCOCCUS SP. WH 8102
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 12176 - protein, 492 aa, Helianthus annuus
MDPYKYRSSSAYNAPFWTTNSGAPVYNNNNSLTVGSRGPILLEDYHLVEKLANFDRERIPERVVHARGASAKGFFEVTHDITALTCADFLRAPGVQTPVIVRLSTVIHERGSPETLRDPRGFAVKFYTREGNFDLVGNNFPVFFIRDGMKFPDMVHSLKPNPKSHIQEDWRIMDFFSHHPESLHMFTFLLDDIGVPQDYRHMDGSGVNTYTLINKAGKAYYVKFHWKPTCGVKSLLEEEAIKIGGANHSHATQDLYDSIAAGNYPEWKLFIQTIDPDHEDRLDFDPLDVTKTWPEDIFPLQPVGRLVLNKNIDNFFAENEQLAFCPAIIVPGIYYSDDKLLQTRIFSYSDTQRHRLGPNYLQLPANAPKCAHHNNHYDGFMNFMHRDEEIDYFPSRYDPARHAEQYPIPPVRLSGKRDKCVIEKENNFKQPGERYRSFSPDRQERFINRVVGGLSDPRVTHEVRSIWVSYWSQADKSLGQKIASRLNVKPNY

SEQ ID NO: 12177 - protein, 94 aa, Triticum aestivum
MINARRIAQLAKRWQRVAALGRKRLTMTATTEVEECSTAVAGEGHCVMYTTDGRRFEVPLAYLRTVVFSELLRMSEEVFGFAGTEGGIKLPCRT

SEQ ID NO: 12178 - protein, 253 aa, Triticum aestivum
  unsure (1)..(253): unsure at all Xaa locations
MGRKFFVGGNWKCNGTVEQVESIVNTLNAGQIASTDVVEVVVSPPYVFLPTVKGKLRPEIQVAAQNCWVKKGGAFTGEVSAEMLVNLXVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGAXCKELAAQPDVDGFLVGGASLKPEFIDIINAATVKSA

SEQ ID NO: 12179 - protein, 456 aa, Porphyra leucosticta
YVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 12180 - protein, 489 aa, Nicotiana tabacum
SKFRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHERGSPESLRDIRGFAVKFYTREGNFDLVGNNVPVFFNRDAKSFPDTIRALKPNPKSHIQEYWRILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWICSLSQADKSCGQKVASRLTLKPTM

SEQ ID NO: 12181 - protein, 388 aa, Streptococcus pyogenes M1 GAS
MKNQLGQLALEQAKTFGGKLEVQPKVDIKTKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLKKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 12182 - protein, 424 aa, Zea mays
MAARAADENRRPAAGKPAPGVRDMASRRALTDIKNLVGAAPYPYAVAKKPMLQKSKRDEKQPALASSRPMTRKFVASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 12183 - protein, 378 aa, Lycopersicon esculentum
MVDEENKVPATAAASRGSNKRAFDSIAITNENDPLQISERPYPANKKRVVLGELNNLGNVIVSTQNSDLTETHESKRKIKLRKTRNVVKETVELKTSANSSPKDNLQKCSYGPLIYQHLHSLEVEERRRPLSNYMEKVQNNVIPSMRTVLVDWLVEVTEEYKLVSDTLYLAVSYIDRFLSSHVLAMEKLQLLGVSCMLVASKYEEISPPHVEDFCYITDNTYTREEVVNMERDLLSFLNFEISSPTTITFLRIFLKAAQDNLSFLTLQFEFLSCYLAELSLLDYSCVRFLPSMTAASAIFLSRFTVLPEVCPWTLALQQCTGYKPSELKDCVLVIHELQSSLMEATGRALREKYMNHKYKCVAALHPPDIPSCFFDDA

SEQ ID NO: 12184 - protein, 319 aa, Methanosarcina barkeri
MERVSHCIESYNHIKTERMTFMDFEQLRHGTELIKRGFARMQKGGVIMDVTNPEQARIAEEAGAVAVMALQAVPADIRKAGGVARMADPEIVQQIIDTVTIPVMAKARIGHFVEAEILEALGVDMVDESEVLTPADPYFHIDKMQFTVPFVCGARNLGEALRRINEGAAMIRTKGEAGTGDVSQAVKHMKQIQGEIRALAGKTKEELIMVSREIEAPIELVVETSKMQRLPVVNFAAGGVATPADAALMMRLGADGVFVGSGIFKAENPEKMAKAVVEAVNNFDNPAKLAEISKGVGAGMKGISADTIPEQEALQERGW

SEQ ID NO: 12185 - protein, 295 aa, Vibrio fischeri
ESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLRNIVDYTEAPLVSIDFNHDPHSAIVDGSQTRVSNGHLVKM

SEQ ID NO: 12186 - protein, 152 aa, Zea mays
NWLCHVLTRAIDTFLRGYSSCQATRATDENAHESPCKAGLLRNMLNLYETVKKAHMVVQVEAAVRVQKELAATEIDGYCEGELIKVTLSGNQQPIRVEITEAAMELGAEKLSGLVNDAYKDAHQRSVQAMKERMADLAQSLGMPAGLGDGLK

SEQ ID NO: 12187 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDIFQKDFGVKTTLPERKLIRRLCELIGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 12188 - protein, 322 aa, Ralstonia metallidurans
MTAPAASFVPLDAAATAARLPYPELAQAIAAMLAELRDGTAMAPPRIALPVGDAERGHGTLLVMPARNRDIVMTKNITVHPDNPQRGLPNILGEVVVANAHTGERIALLDGPTVTGRRTAAVSLLAAQSFAPVPDGELLIVGAGVQAQTHLEAFVAGLPVRKVWLHSRTRDKAEALAEHAGRLGVSATVIDDVAEVLPRVSMVVTVTSSRTPVLPDLDSGLWTDRHFIAAVGAFRPEMCELPPRLCHAAAASGRLLADTLFGIEDEAGDLLQAGIDWQTVQPFETAILEADALRARTGSPLVFKSVGYALWDLAACALASKK

SEQ ID NO: 12189 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFSYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 12190 - protein, 144 aa, Zea mays
MINAKKIAHLAKKWQRMAAQGRRRLTLGATSANGADECCSSVASKGHCAVYTADGARFEVPLACLSTPVFGELLQMSEEEFGFAGGDGRITLPCDAAVMEYAMCLLRRGASAELEQAFLSTMAMSCHCASHMAPYVGATHQIAV

SEQ ID NO: 12191 - protein, 238 aa, Ceratopteris richardii
MVRRKIKIKRIENATTRQVTFSKRRGGLLKKAHDLSVLCDAEVAVIIFSSKGKLFQFANPSMETVLGRYVKASRDPEAGDNGSSTDNVEADRLTVFTEKLKMLQSNVIGDDLERLSLRDLIHLEQQVHESLGHIRAKKDELILEQIDEFKQKMADTRRTTNANTSMLDRLVDFCSSGITGSQNIVASEPGYVVGVPRTDTLRAGWIATSDQSNDGPEYVPCAKRFRITEGLNESPASE

SEQ ID NO: 12192 - protein, 400 aa, Glycine max
MQSTATTPLYQLVSFKPKLQTFPSKSQLCPLGTPFCRLEMASVSGFGLKPLRAVGGSSSSSASSDDGFVTLIEYVGKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 12193 - protein, 348 aa, Kluyveromyces lactis
MSIPETQKGVIFYENGGELQYKDIPVPKPKANELLINVKYSGVCHTDLHAWKGDWPLPTKLPLVGGHEGAGVVVAMGENVKGWIIGDFAGIKWLNGSCMSCEYCELSNESNCPDADLSGYTHDGSFQQYATADAVQAARIPKGTDLAEVAPILCAGVTVYKALKSADLKAGDWVAISGACGGLGSLAIQYAKAMGYRVLGIDTGAEKAKLFKELGGEYFVDYAVSKDLIKEIVDATNGGAHGVINVSVSEFAIEQSTNYVRSNGTVVLVGLPRDAKCKSDVFTQVVKSVSIVGSYVGNRADTREALDFFARGLVHAPIKIVGLSELADVYDKMVKGEIVGRYVVDTSK

SEQ ID NO: 12194 - protein, 637 aa, ASPERGILLUS NIDULANS FGSC A4
MSGMRVALRTPLRALGDPASVLQYTASPYAPRELATWNSYKPPRYWLFSSLRFNKATFPQHNFRTPFSTKTLYRFETQQRAGGQGRQSQNSQSRNKWIGYGIIGGTIVVGGVVVSDDIRHIYHAAARTGRVVGTLAVCINDYRVTLKQETCTPEERNEAIRACHKRCADRTLHVLERNGSIFIKLGQHLSSMGYLLPLEWTTTFIPLQDKCPVSSVESIEQMFVKDTGKRIDELFTTFEPTPIGAASLAQVHIGTLKETGEKVAVKVQHPALAEWAPLDLALTRFTFSMLKRFFPEYDLEWLSKEMDLSLPQELDFRMEAQNAKRASEYFKKNSNAPLVIPKVLWAQKRILVMEFISGSRPDDLEYLDKNHIDRDEVSAALAHIFNEMIFGDNAPLHCDPHGGNIAIRKNPNRSRHNFDIILYDHGLYRDIPRETRRNYAKLWLSVIEADEARMREYSRKVAGVTDEQFPLFASAITGRDYTVLTKKNITSLRTEAEKESITGALGEGLLQQLVELLGQVPRIMLLILKTNDLTRSLDENLHTRQGPVRTFLILARYATRTVFEEQMDTINESEFQFLEQPDRDNMYLSGLYLMRNTFDLVPLWLAHLKSTPPANPSRQLQQNHLSITTFFIDQHHD

SEQ ID NO: 12195 - protein, 508 aa, ASPERGILLUS NIDULANS FGSC A4
MATVNEKAAPLSTTDPEVQQDSQRLPGKPWMYKNLKLGPLTVPYYASPQFQLVLVAFVCFLCPGMYNSVNGLGGAGQLNHSDISKSNTATYSTFAVVGFFAGSIANRIGLRLTLSFGGFGYTLYVAALLCYNHTYNSGFLIFAGALLGLCAGLLWCAQGAVMMAYPGENEKGKFISIFWVIFNLGGVIGGLIPLGQNIHNSDSAGSVNDGTYIAFMVLMVLGFLLAWGLVDSKNIVRKDGTRVIAIKNPSWKSELLGLYETLLTDWYIVAFFPMFLASNWFYSYHFNAINGSYFVPRAAALNSILYWAMQMIGAFCFGLILDLKSLKRPARAKLVWVLLFTITMGVWGGGYAFQKTYTRETAGRSKDWNQSGYIGPMFLYMFYGFYDAAFQTCAYWFMGCLSNNSRKLANFAGFYKGIQSAGAAITWALDFNETPYMNMFASCWGILCGSLLIASPIIFFKIKDHTDLEEDLKFSDETVADVTGIEVGDVTLRPQQQHTPEKRSPSDA

SEQ ID NO: 12196 - protein, 458 aa, Zymomonas mobilis
MAYESVNPATGETVKKYPDFSDKQVKDSVDRAATVFKNDWSQRTIAERSKVLHKAAEIFRSDVDKYAKLLTIDMGKKIAEARGEVNLSADILDYYAKNGEKFLAPQKVEEKPGAVVKAFPLGLLLAIEPWNFPYYQLARIAGPYLIAGNALLVKHSSSVPQSAHAFEAVLEEAGAPKGIYTNLDASPDQVSQIIEDPRVRGVTVTGSASVGAELAAKAGKMWKKSVMELGGSDAFIVLDGVDIDDKLIDKAAYGRLFNAGQVFCAAKRFIIVGQKRAELFTEKLKQRFEALKIGDPMDESTDLGPLSSVGARDQVVKQVEKAVQNGAKLVCGGKAIEGKGAFMKAGILTDIKRENPAYFEEFFGPIAQIYAVKDEAEAIELANDSPYGLGGAVFAPDVEQGRKVAEQIETGMVAINKPLWTAPELPFGGVKHSGYGRELSHFGIQEFINWKLIDASAA

SEQ ID NO: 12197 - protein, 296 aa, Triticum aestivum
ELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMSLCEQPPKFEFYDPKTPFFTSPRYLPPTKSDKCRIKEAIILHGCFLRECKIEHSIIGVPSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 12198 - protein, 238 aa, Desulfitobacterium hafniense
MIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRKVEAEKGREDQCIQRYDN

SEQ ID NO: 12199 - protein, 337 aa, Oryza sativa (japonica cultivar-group)
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 12200 - protein, 162 aa, Triticum aestivum
MEGRMFGLETPLMTALQHLLDVPDGEAGGPGNAAGEKQGPTRAYVRDARAMAATPADVKELPGAYAFVVDMPGLGSGDIKVQVEDERVLVISGERRREEKEDAKYLRMERRMGKMMRKFVLPENADMEKISAVCRDGVLTVSLEKLPPPETKKPKTIQVQVA

SEQ ID NO: 12201 - protein, 342 aa, Lactobacillus plantarum WCFS1
MADVQLDWNNLGFEYRNLPYRYRAYWKDGAWYKKELTGDATLHISEGSTALHYGQQDFEGLKAYRTKDGSVQLFRPDRNAARMQTSCERLLMPQVPTDMFVDAVKQVVKANQDYVPPYGTGATLYLRPLMIGVGGNIGVHPAQEYIFTVFAMPVGSYFKGGMTPTNFTTSEYDRAAHKGTGAYKVGGNYAASLFPGQEAHANGFSDCVYLDPVEHRKIEEVGSANFFGITKDGTFVTPKSPSILPAVTKYSLLYLAEHKFGMKTEQGDVYIDDLDRFAEAGACGTAAVISPIGGLEHQGKLHVFYSETEVGPVTKKLYDELTGIQFGDREAPEGWVQKVELD

SEQ ID NO: 12202 - protein, 341 aa, Oryza sativa; identical to SEQ ID NO: 7795

SEQ ID NO: 12203 - protein, 480 aa, Glycine max
MSTQNRRSSFSSSTTSSLAKRHVSASTTSSSLAAPANMAKKRPPLSNLTNTVAHRNSSSLVPCAAKFAKTKKEVVPACSGNKRPTLANVKPTSAAIFPKANSFPVRDEAPPPVATVTVPAPVVDVSPSKSDAMSVSMDESMSSCDSFKSPDIEYVDNIDVAAVDSIERKTFSNLNISDSTEGNICSRDILVELEKGENFVNVDNNYADPQLCATFACDIYKHLRASEAKKRPSTDFMERIQKEINPSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLIAASAIFLAKFILFPSKKPWTSTLQHYTLYKPSDLCVCVRDLHRLCCNSPNSNLPAIREKYSQHKYKYVAKKYCPPSIPPEFFQN

SEQ ID NO: 12204 - protein, 719 aa, Oryza sativa
MWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNRQVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQKALSMLCCWIENPNSDAFKRHLARVADFLWVGEDGMKVRVCAGQLWDVAFAVQAILACSIAEEFGSTLKKAHGFIKTSQIMDNPSGDFSRKYRHISKGGWAFQVADQGWQVSDCTAEALKALLLLSKCLSDGADYQMETYCYFDAVNVLLSLQNPNGGYGAWELARTYPWMEIFNMTEIYADIIVEHQYVECTSSVIQALALFREKYPGHRKDEIDQCIRKATEFIEKLQNDDGSWFGSWGICFTYGTWFAIEGLSAVGQCYDDSTCIRKACKFLLSKQLTNGGWGESHLSSRTKAYTNLDGEKSHIVNTAWAMLALMKAGQVERDPAPLHKAARLIMSMQLSDGDFPQEEMIGSFLKNGPLCYMAYRNIFPIWALGEYQKLVFQNYQTSSIKQTNIAPSAGNAALKNSASTTAPT

SEQ ID NO: 12205 - protein, 358 aa, Brassica oleracea
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKEKIVLKPLPEMVSVESPAKFPPRTFAQHIEHKLFRNEQEELVTEKKDEV

SEQ ID NO: 12206 - protein, 559 aa, Raoultella terrigena
MDKPRHERQWAHGADLIVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKLVHQSMDTVAMFSPVTKYAVEVTASDALAEVVSNAFRAAEQGRPGSAFVSLPQDIVDGPASGSTLPASRAPQMGAAPDGAVDSVAQAIAAAKNPIFLLGLMASQPENSRALHRHAGKKPYSGHQHLSGAGAVNQDNFARFAGRVGLFNNQAGDRLLRQADLIICIGYSPVEYEPAMWNSGTATLVHIDVLPAYEERNYVPDIELVGDIAATLEKLAQRIEHRLVLTPQAADILADRQRQRELLDRRGAQLNQFALHPLRIVRAMQDIVNSDVTLTVDMGSFHIWIARYLYSFRARQVMISNGQQTMGVALPWAIGAWLVNPQRKVVSVSGDGGFLQSSMELETAVRLHANILHIIWVDNGYNMVAIQEQKKYQRLSGVEFGPVDFKVYAEAFGACGFAVESAEALEPTLRAAMDVDGPAVVAIPVDYRDNPLLMGQLHLSQIL

SEQ ID NO: 12207 - protein, 919 aa, Streptomyces lividans
MPATRRTARVRRVAAVTVTALAAALLPPLAARADTPPAPPSDAKLAKTAARHDLTREQFYFSCRTLRQRGRRERPRRLTGTRLTTGYDPTDKGFYQGGDLKGLTEKLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPTAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEPSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASGRLHHRHPARRGGAHRRLPGPRGRPLQARRRELRRLGPVRLGRPRRREAHHLARHPPLHRPGRLRAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYMVHKGDEKDLPTDQAWTSRPTATRCGC

SEQ ID NO: 12208 - protein, 378 aa, Triticum aestivum
  unsure (1)..(378): unsure at all Xaa locations
MDTSGGGGGAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLQRTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAXPFSFDFEQPSFTEEHMKELIWRETLAFNPDPPY

SEQ ID NO: 12209 - protein, 278 aa, Oryza sativa (japonica cultivar-group)
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKRARPS

SEQ ID NO: 12210 - protein, 556 aa, Arabidopsis thaliana
MSPLPIFHRLPHATFSSFLLSLSQAGSSKTSVAFLNAFKSEDIIARIGLWWQLIRAVVVVPVFKFLVVLCLVMSVMFFVEVMYMGIVVLYVKLFKRKPEKFYKWEAMEDDVECGSASYPMVLVQIPMYNEKEVCEQSIAAACKISWPSNRIIIQVLDDSTDPASKELVKKECDRWSKEGVNITFEIRDNRNGYKAGALREGMRHSYVKQCDYVAIFDADFQPDPDFLHRTVPFLIHNPKLALVQGRWEFVNAGQCMMTRLQEMSLSYHFTIEQQVGSSTFAFFGFNGTAGVWRISALNESGGWNDQTTVEDMDLAVRATLRGWKFLYIDDLKVKSELPCSFKALRSQQHRWTCGPANLLRKMAGQIIRSENVSLWKKWYMLYSFFFMRKIVAHILTFCFYCVILPATVLFPEVTVPKWAAFYLPSLITLLIAIGRLRSIHLLAFWVLFENAMSLLRAKALVMGLFETGRVQEWVVTEKLGHTLKTKLIPQVPNVRFRERVHLLELLVGAYLLFCGIYDIVYGKNTLYVYLLFQSVAFFVVGFGFVGKYVPASSYLA

SEQ ID NO: 12211 - protein, 365 aa, Stylosanthes humilis
MGSTGETQITPTVVSDEEANLFAMQLASASVLPMVLKSAIELDVLEIIAKAGPGVHLSPADIAANVPTTNPDAAVMLDRMLRLLACYNILNHSLRTLPDGKVERLYGLAPVAKFLVKNEDGVSLSALNLMNHDKVLMESWYYLKETVLEGGIPFNKAYGMTAFEYHGTDPRFNKVFNKGMNDHTTITMKKILEIYTGFEGLKSLVDVGGGVGAVVNMIVTKYPHIKGINFDLPHVIEDAPSYPGVEHVGGDMFVSVPKADAVFMKWICHDWSDEHCIKFLKNCYDAVPDNGKVIVAECILPVAPDSSLATKGVVHIDVIMLAHNPGGKERTEKEFEALAKAAGFQGFRVVCCAFNTYIMEFLKKP

SEQ ID NO: 12212 - protein, 141 aa, Zea mays
  unsure (1)..(141): unsure at all Xaa locations
MSGNGAKKVVDAAVKAGRTIIDWDGMAKLLVTDEARKEFAALRRVDILQKYPVPECDIWFIKFSCDFHFNQLAIGNREGKIYVWEVQSSPPVLIARLYNQQCKXPIRQTAVSFXDGSXILGAGEXGTIWRWDEVDHPSSRN

SEQ ID NO: 12213 - protein, 711 aa, Geobacillus stearothermophilus
MKRWLSVVLSMSLVFSAFFLVSDTQKVTVEAAGNLNKVNFTSDIVYQIVVDRFVDGNTSNNPSGSLFSSGCTNLRKYCGGDWQGIINKINDGYLTEMGVTAIWISQPVENVFAVMNDADGSTSYHGYWARDFKKTNPFFGTLSDFQRLVDAAHAKGIKVIIDFAPNHTSPASETNPSYMENGRLYDNGTLIGGYTNDTNSYFHHNGGTTFSNLEDGIYRNLFDLADFNHQNQFIDKYLKDAIKLWLDMGIDGIRMDAVKHMPFGWQKSFMDEVYDYRPVFTFGEWFLSENEVDSNNHFFANESGMSLLDFRFGQKLRQVLRNNSDDWYGFNQMIQDTASAYDEVIDQVTFIDNHDMDRFMADEGDPRKVDIALAVLLTSRGVPNIYYGTEQYMTGNGDPNNRKMMTSFNKNTRAYQVIQKLSSLRRSNPALSYGDTEQRWINSDVYIYERQFGKDVVLVAVNRSLSKSYSITGLFTALPSGTYTDQLGALLDGNTIQVGSNGAVNAFNLGPGEVGVWTYSAAESVPIIGHIGPMMGQVGHKLTIDGEGFGTNVGTVKFGNTVASVVSWSNNQITVTVPNIPAGKYNITVQTSGGQVSAAYDNFEVLTNDQVSVRFVVNNANTNWGENIYLVGNVHELGNWNTSKAIGPLFNQVIYSYPTWYVDVSVPEGKTIEFKFIKKDGSGNVIWESGSNHVYTTPTSTTGTVNVNWQY

SEQ ID NO: 12214 - protein, 182 aa, Glycine max
ISENGEDIQVLRYEHGQKYDPHYDYFTDKVNIARGGHRIATVLMYLTNVTTGGETVFPSAEEPPRRRGTETSSDLSECAKKGIAVKPHRGDALLFFSLHTNATPDTSSLHAGCPVIEGEKWSATKWIHVDSFDKTVGAGGDCSDHHVSCERWASLGECTKNPEYMIGSSDVPGYCRKSCKSC

SEQ ID NO: 12215 - protein, 758 aa, Caulobacter crescentus CB15
MISTTLRSLSLALLISASASALSVVPALADAAKPAAALAHPWMDKSLDADKRADLVLKAMTNDEKFTLIFGYFGADMKPKYTRIPESLPGSAGYIAGVPRLGIPAQFQTDAGVGVATQGSAKEFRERTALPSGMATTATWNPELAFQGGAMIGKEARDSGFNVQLAGGVNLVREPRNGRNFEYGGEDPLLAGVMVAAQIRGIQSNNIISTIKHYALNAQETGRFVVSSNIDDTAARMSDLLAFQFAIEQSDPHSVMCAYNRVNSVYACESDWLLNTVLKKDWGYKGYVMSDWGAAHSSAKAANAGLDQESAGDAFDKQPFFAAPLKADLASGAVSQARIDDMARRVLRAMFASGVVDHPLTGAPLAMPAETLAAHAKITQADAEEGIVLLKNDGGLLPLAKTAKTIAVIGSYADVGVLSGGGSSQVYPVGGRAVQGLEPKTWPGPVIYYPSSPLKAIAARYPGAKVVYDDGTDPARAAKLAASSDLALVFADQWTTESVDVTTLNLPKNQDATIDAVASANKKTVVVLLTGGPLLMPWLDKVGAVVEAWFPGTAGGEAIARVLTGEVDASGRLPVTFPKSVAELPRPKLDGLGKPDGEMFDVDYTLEGAAVGYKWYDLKKIEPLFAFGHGLSYTQFAYSNLTASASGDTLTVSFEVKNVGRRPGKDVPQVYVGPKAGGWEAPKRLAGFQKVSLAPGASQRVTVTVDPRLLAVWDSKAHGWSIAAGQYDIALGASSRAISSTAQVTLAARSLPVSPAAK

SEQ ID NO: 12216 - protein, 330 aa, Neurospora crassa
MVKAVVAGAAGGIGQPLSLLLKLSPLVDELALYDVVNTPGVAADLSHISSPAKTTGYLPPNDGAKAAFKDADIIVIPAGIPRKPGMTRDDLFNINAGIVKGLIEVAADVAPNAFILVISNPVNSTVPISAEVLKAKGVFNAQRLFGVTTLDIVRAETFVAEIAGNSNPQELVVPVIGGHSGETIVPLFSKVSPSVTIPDDKYDALVNRVQFGGDEVVKAKEGLGSATLSMAYAGYRFAEKLLKAAKGAKGLVEPTYVYLPGIPGGKEIAEKTGVDFFSVPVELGPNGAEKAIDILGDITEKEKTLLEAAIKGLKGNIQKGVDFAHNPPQK

SEQ ID NO: 12217 - protein, 101 aa, Lavatera thuringiaca
MAISKALIASLLISLLIIQIVEADHQLVTSASKGSSFPKKIDCGGACAARCQLSSRPHLCKRACGTCCARSRCVPPGTAGNQEMCPCYASLTTHGGKRKCP

SEQ ID NO: 12218 - protein, 510 aa, Mycobacterium tuberculosis H37Rv
MTTQISHFIDGQRTAGQSTRSADVFDPNTGQIQAKVPMAGKSDIDAAVASAVEAQKGWAAWNPQRRARVLMRFIELVNDTIDELAELLSREHGKTLADARGDVQRGIEVIEFCLGIPHLLKGEYTEGAGPGIDVYSLRQPLGVVAGITPFNFPAMIPLWKAGPALACGNAFVLKPSERDPSVPVRLAELFIEAGLPAGVFQVVHGDKEAVDAILHHPDIKAVGFVGSSDIAQYIYAGAAATGKRAQCFGGAKNHMIVMPDADLDQAVDALIGAGYGSAGERCMAISVAVPVGDQTAERLRARLIERINNLRVGHSLDPKADYGPLVTGAALARVRDYIGQGVAAGAELVVDGRDRASDDLTFGLPEGDANLEGGFFIGPTLFDHVAAHMSIYTDEIFGPVLCMVRARDYEEALRLPSEHEYGNGVAIFTRDGDAARDFVSRVQVGMVGVNVPIPVPVAYHTFGGWKRSGFGDLNQHGPAAIQFYTKVKTVTSRWPSGIKDGAEFVIPTMS

SEQ ID NO: 12219 - protein, 332 aa, Saccharomyces cerevisiae
  unsure (1)..(332): unsure at all Xaa locations
MIRIAINGFGRIGRLVLRLALQRKDIEVVAVXDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLAKEATYDQIKKAVKAAAEGPMKGVLGYTEDAVVSSDFLGDTHASIFDASAGIQLSPKFVKLISWYDNEYGYSARVVXLIEYVAKA

SEQ ID NO: 12220 - protein, 499 aa, Burkholderia fungorum
WAYFPLFSNHGGTPAVINGPAYPQFVSGIGYDNPGRLVHIVKRRLQVVDFRLTDTRAKEQHVSVPVSAFDEDKFESGHAFDGSSIAGWKGIEASDMLLVPDANTAFIDPFYEESTLVLTCDVVEPADGKGYERDPRSLAKRAEAYLKSTGLGDTAFFGPEPEFFIFDSVKWGTDQSGTFVKIGSEEAPWSSALDFEGGNTGHRPGTKGGYFPVAPVDTFQDIRSEMCLLLEQIGIPVEVHHHEVAGQGQNEIGTKFSTLVQRADWLQQMKYIIHNVAHTYGKTATFMPKPVVGDNGSGMHVHQSIWKDGTNLFAGNGYAGLSEFALFYIGGIIKHARALNAITNPSTNSYKRLVPHFEAPVKLAYSARNRSASIRIPHVSNPKGRRIETRFPDPMANPYLCFSALMMAGLDGVQNKIHPGEAADKNLYDLPPEEDAKIPTVCAGLDQALDSLDADREFLTRGGVFTDSMLDAYIELKTGELQRYRQSVHPIEFEMYYSL

SEQ ID NO: 12221 - protein, 368 aa, Zea mays
MAPAKAQRAGTDQQALLDAQLQLWHHAFAFVKSMALKAALDLRIPDAIHLHGGSATLPQIVTELATLHPSKTPCLRRLMRVLTLTGVFGVVVQHSTTDGGSDLVYELTPASRLLVGSAPSNGPNVSPFLNMILGTAFVSSFLDLGEWFQHELPDPSPFKLAHGRHVWDMARHDASFAKLCDSGMVADSGFIMDVVVKECGDVFRGVGSLVDVAGGLGGATQTIAKAFPDVACSVLDLSHVVANAPTDTTVKYIAGDMFESIPSANVVFLKWILHDWGDAECVKILKNCKKAIASQEEGKVVILDMVVGAGSSDEKHVETQIVFDLFMMFINGTERDETEWKKIIFEAGFSRYKIIPVLGVRSIIEVYP

SEQ ID NO: 12222 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 12223 - protein, 364 aa, Salmonella typhimurium
MALFNTAHGGNIREPATVLGISPDHLLDFTANINPLGMPVSLKPPLIDNLDCIERYPDADYFHLHQALARHHQVPASWILAGNGETESIFTVASGLKPRRAMIVTPGFAEYGRALAQSGCEIRRWSLREADGWQLTDAILEALTPDLDCLFLCTPNNPTGLLPERPLLQAIADRCKSLNINLILDEAFIDFIPHETGFIPALKDNPHIWVLRSLTKFYAIPGLRLGYLVNSDDAAMARMRRQQMPWSVNALAALAGEVALQDSAWQQATWHWLREEGARFYQALCQLPLLTVYPGRANYLLLRCEREDIDLQRRLLTQRILIRSCANYPGLDSRYYRVAIRSAAQNERLLAALRNVLTGIAPAD

SEQ ID NO: 12224 - protein, 519 aa, Brassica napus
MSGAITCSAADLATLLGPNATAAADYICGQLGTVNNKFTDAAFAIDNTYLLFSAYLVFAMQLGFAMLCAGSVRAKNTMNIMLTNVLDAAAGGFFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMTSLVLIGCNKLAELVQYGDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALPLAFNFQLFGNLLPFKYCLGFGFEI

SEQ ID NO: 12225 - protein, 479 aa, Streptomyces coelicolor A3(2)
MTDTPTQLFLGGAWADAADGAVMPVDDPATGEILAHVADAGPKDARLAEEAAVQAQEEWARAAPRARSEILRRAYEIVLERTDALARLMTSEMGKPLAEARGEVAYAAEFFRWFSEEAVRIDGGHGVLPDGRNRMLLSRRPVGPCLLITPWNFPLAMGTRKIGPAVAAGCTMVLKPAPQTPLSSLALAAILKEAGLPDGVLNVVTTSRAGEVCEPLLRGGRIRKLSFTGSTAVGRLLLAQCADTVVRTSMELGGNAPFVVFDDADLDAAVDGAMVAKMRNMGEACTAANRFFVHRSVAGEFADRLARRMGALVVGPGTGDGVDVGPLIDAAGRAKVEELVADAVERGARVLVGGTTPEGPGCFYPPTVLTDVAPESRLMATEIFGPVAAILTFDDEDEVVRRANDTPWGLVGYVFTEGLDRALRVSERLDVGMVGLNTGLVSNPAAPFGGVKQSGLGREGGRVGIEEFLEYQYVALPTG

SEQ ID NO: 12226 - protein, 492 aa, Hevea brasiliensis
MDPYKNLPSNAYNCSFWTTNSGAPVWNNNSSLTVGARGPILLEDYHLLEKLANFDRERIPERVVHARGASAKGFFEVTHNVSQLTCADFLRAPGVQTPVIVRFSTVIHERGSPETIRDPRGFAVKFYTREGNFDLVGNNFPVFFIRDGMKFPDVVHAFKPNPKSHIQESWRIFDFLSHVPESLHMLTFLFDDLGIPQDYRHMEGSGVNTYTLINNAGKVHCVKFHWKPTCGVKCLLEEEAIKVGGSNHSHATQDLYDSIAAGNYPEWKLYIQTMDPDHEDKFDFDPLDVTKTWPEDILPLQPVGRLVLNKNIDNFFAENEQLAFCPGIVVPGISYSEDKLLQTRIFSYSDTQRHRLGSNYLQLPVNAPKCAHHNNHHDGFMNFMHRDEEVNYFPSRCDPVRHSERFPIPSTICSGRRDKCVIEKENNFEQPGERYRSWAPDRQERFLNRMVGCLSDPRITHELRSIWISYWTQCDRSLGQKLAFRLNVRPSI

SEQ ID NO: 12227 - protein, 543 aa, Schizosaccharomyces pombe
MDETIGMKKEFHDISVGDIEVGESAPVTEDDKMLLNLGYKQEFKREFSLLAVFGQSFGSMGLCPSLVGSMAFSMNCGAGGMVWSWFVGATCLLPIAFALSELASSMPTSGSLYFWTAYLSPPKYRAFLSWFLGYVLALAYSTGFASTIYAAAGLVQATASVANPSYAPTKYEEYGIYVALSFACSALIVLPTKFLARFSSFNVVFQICTILIFIISLAASSTSETRNTGSYIFGNFENYSGWTNMGWSFILCFTTPVWVLSGFESCATIVEEAKNASKAAPIAIISSLTVSLFMGFCIMITIAGTMGHDFSSILNTPYGEPVSQVLYNNLGKRGAVGVSAVLIIALCFNCSALCLASSREIFAFARDKGLPGSWIFRKLTPGGIPLNAILLVNLYTIIVGLLMLVNVTAISSIFNLAIIAFFISYSLPLVCRLLFNRLNPGKFYCGKFSKPISIVAVAWLWFMALMLLFPSYQNPNKVEMNWAIVVLGFTVFFCVGYYYLPKYGGKTFFKGPVKTVDENVTEGVTVDFQADHVSKEDDGKSYN

SEQ ID NO: 12228 - protein, 170 aa, Bacillus anthracis str. A2012
MDFKQHIAIVPDYPKEGIVFKDITPLMNDGKAYKAATDAIVEYAKERDIDLVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 12229 - protein, 318 aa, Cytophaga hutchinsonii
MKVTEHIAQAKGKTLFSIEILPPLKGQNIQSIFDAIDPLMEFKPPFIDVTYHREDYQIKERADGTKEKITVRKRPGTVGICAAIMNRFKVDAVPHLICGGFNRQETEDALIDLQFLGIDNVLALRGDPIKFEGSFVAKPGGYNYACELVSQINDMNKGIYVEEDLLNPAPTNFCIGVAAYPEMHMDAASMEVDMRNLKHKVACGSDYIVTQMFFDNKKYLDFVANCRANGITIPIIPGIKPLTTKKQLQILPKIFHLVIPEDLVKEVEKCKDDEQVRQVGIEWAIQQSKELMQAGTPVLHYYSMGKSDTVKSIASNVF

SEQ ID NO: 12230 - protein, 516 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 12231 - protein, 337 aa, Triticum aestivum
  unsure (1)..(337): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLASLAKIINDNFGIIEGLMTTVXAITGPQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 12232 - protein, 363 aa, Zea mays
  unsure (1)..(363): unsure at all Xaa locations
MDSFGDLGGGGSSSSRAASAPFLQLPLPASTSSSXTTTTGVSAAGRAAAAALSPQLAHPVATVTVTGRPVVGSXHSHRKADMATVQGEMSSPAADGDADAIKARIMSHPQYSALLAAYLNCQKVGAPPDVSDRLSAMAAANLDAQPGPISRRRGPTTTRADDPELDQFMEAYCNMLVKFHEEMARPIQEATEFFNSMERQLGSTISDSNCEVAGSSEDEQDASCPEEIDPCAEDKELKHQLLRKYGGYLGGLRQEFSKRKKKGKLPKEARQKLLHWWELHYKWPYPSETEKMALAETTGLDPKQINNWFINQRKRHWKPASEDMPFAMMEGGFHVAQGTAALYMDRPAPPFMADDGGMYRLGS

SEQ ID NO: 12233 - protein, 509 aa, Prunus cerasus
MTDRRAQDNAVSGQPLLKKKPKRNLYAIGCAILASMTSILLGYDIGVMSGASIYIQKDLKISDVEVEILIGILNLYSLIGSAAAGRTSDWIGRRYTIVFAGAIFFTGALLMGLATNYAFLMVGRFVAGIGVGYALMIAPVYNAEVSPASSRGALTSFPEVFVNIGILLGYVANYAFSGLPIDLGWRLMLGVGVFPSVILAVGVLSMPESPRWLVMQGRLGEAKQVLDKTSDSLEEAQLRLADIKEAAGIPEHCVEDVVQVPKHSHGEEVWKELLLHPTPPVRHILIAAIGFHFFQQLSGIDALVLYSPRIFEKAGITDSSTLLLATVAVGFSKTIFTLVAIGFLDRVGRRPLLLTSVAGMIASLLCLGTSLTIVDHETEKMMWASVLCLTMVLAYVGFFSIGMGPIAWVYSSEIFPLKLRAQGCSMGTAVNRIMSGVLSMSFISLYKAITMGGTFFLYAGIATVGWVFFYTMLPETQGRTLEDMEVLFGKFWRWREGYALLRNKRAVVC

SEQ ID NO: 12234 - protein, 99 aa, Glycine max
  unsure (1)..(99): unsure at all Xaa locations
MAPSTISNPGAGFVDRAVPSMIATITGLRIMAGFPTRKTNKDXTFIDCNGGRVHCMHVWPPVGKKKCENLSYLTDLEDAQWAKEAEYLVREGMDINARN

SEQ ID NO: 12235 - protein, 253 aa, Triticum aestivum; identical to SEQ ID NO: 7773

SEQ ID NO: 12236 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDQGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 12237 - protein, 326 aa, Corynebacterium glutamicum ATCC 13032
MSLTNIPASSQWAISDVLKRPSPGRVPFSVEFMPPRDDAAEERLYRAAEVFHDLGASFVSVTYGAGGSTRERTSRIARRLAKQPLTTLVHLTLVNHTREEMKAILREYLELGLTNLLALRGDPPGDPLGDWVSTDGGLNYASELIDLIKSTPEFREFDLGIASFPEGHFRAKTLEEDTKYTLAKLRGGAEYSITQMFFDVEDYLRLRDRLVAADPIHGAKPIIPGIMPITSLRSVRRQVELSGAQLPSQLEESLVRAANGNEEANKDEIRKVGIEYSTNMAERLIAEGAEDLHFMTLNFTRATQEVLYNLGMAPAWGAEHGQDAVR

SEQ ID NO: 12238 - protein, 212 aa, Paenibacillus macerans [sequence omitted]

SEQ ID NO: 12239 - protein, 508 aa, Vibrio vulnificus
MHMSKSFLLISMGLASISVHAQTLTRDNGAPVGDNQNSITAGENGSVLLQDVHLIQKLQRFARERIPERVVHARGTGAHGEFVVSGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINRKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 12240 - protein, 754 aa, Glycine max
  unsure (1)..(754): unsure at all Xaa locations
MQQGDPTVLSLRPGGGRGGGSRLFAHSSSSSSLSADLPLCRPHAYFSLKTRDSRFEGHERVRYSRDQLLQLQEAVEVPDDILKIKQDIEAEIFGENPSWGRAESNLPHQLQNRYSEPDNRDWRGHSGQLPANSDERSWENLRDNRETQISSMQGGGPTPTLVKAXEVPWSARRGSLSEKYCVLKTVKGILNKLTPEKFDVLKGQLIDSGITSADILKDVISLIFDKAVLEPTFCPMYAHLCSDLNEKLPPFPSEEPGGKEITFKRVLLNNCQEAFEGAENLREELKRMTVPEREMERTDKGTLLKLRTLGNIRLIGELLKQKMVPEKIVHHIVQELLGSPDSKSCPVEENVEAICQFFNTIGKQLDESLKXRRINDIYFSRLKELSSNLQLVPRLRFMIRDVIELRASNWVPRREEVKAKTITEIHSEAEKNLGLRPGATASMRNPRGGVQGNASSGGFPIARPGAGGLMPGMPGTRKMPGMPGFDNGNWEMPKTRSMPRGDLPGVQAAGQSNSALLSKSTTLNSKLLPQGSGGIISGRNSALVHGCGTFFGLGPEAAPQLSSPAKTATPVPVSSEKPQHPAARLNTDNLRCRTVSLLEEYFSVQLLEEALQCVEELKSPSYHPEVVKEAISLALDKSPPCVEPVANLIEYLYIKKILTPIDIGTGCLLFGSLLDDIGIDLPKAPSNFGEIIGKLILAGGLDCKLVREILKKVDDGMFQRAIFDSVVGAIRSASGQAVLDAQTSDIEACQSMLK

SEQ ID NO: 12241 - protein, 299 aa, Streptococcus pneumoniae R6
MTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQAPGAGNEIQLTDAIDTLNKTQRVFAREFTGARYDVGDKFGFMKTSIDYALKHPQVKDDLKNYLIQLGKELTEKE

SEQ ID NO: 12242 - protein, 254 aa, Zea mays
  unsure (1)..(254): unsure at all Xaa locations
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTXGKVATTEQXAQEVHXRIRDLLRSISDKVAXETRILXYGGRVNEKNCGELSRQADIDGSLVGXXSQPAFVDIITLPAVTINSK

SEQ ID NO: 12243 - protein, 469 aa, Porphyra schizophylla
  unsure (1)..(469): unsure at all Xaa locations
VIRYAKMGYWDADYVIKEPDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPIAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQXMAIWARKHDMILHLQRAGNSTYSRQKNHGMNFRVICKWMRMAGVDHIHAGTVVGKLEGDPLMIKGFYNTLLESDTEINLPQGLFFAQNWASLXKVVPVASGGIHAGQMHQLLDYLGDDVVLQFGGGTIGHPDGIQAGATANRVALESMVRARNEGRDYVAEGPQILRXAAKTCGPLQTALDLWKDISFNYTSTDTADFVETPTANV

SEQ ID NO: 12244 - protein, 220 aa, Populus tremuloides
MVRGKTQMRRIENATSRQVTFSKRRNGLLKKAFELSVLCDAEVALIVFSPRGKLYEFASSSMQETIERYRRHVKENNTNKQPVEQNMLQLKEEAASMIKKIEHLEVSKRKLLGECLGSCTIEELQQIEQQLERSVSTIRARKNQVFKEQIELLKQKEKLLAAENARLSDECGAQSWPVSWEQRDDLPREEQRESSSISDVETELFIGPPETRTKRIPPRN

SEQ ID NO: 12245 - protein, 244 aa, Triticum aestivum
MFGYRKAPDLDLEAGGSAPLYPGMTEDVELRWAFIRKIYVILSVQLAMTAAVAGFVVKVPAVSDFFVSSNAGLGLYIFLLVLPLIVLCPLRYYHQKHPVNLILLGVFTVSISFAVGMTCAFTSGKIILEAAILTAVVVISLTAYTFWAAKRGHDFNFLGPFLFGALMVLLVFSLIQIFFPLGKISTMIYGAVASIIFCGYIIFDTDNIIKRHTYDEYIWAAVSLYLDIINLFLNLMQILRAADS

SEQ ID NO: 12246 - protein, 370 aa, Oryza sativa
  unsure (1)..(370): unsure at all Xaa locations
MIMVLAKCTRCLALVVVVLVGVAAPVVFSVTDGLLPNGNFEHGPDKSQLNXNWEISGFVEYIGSGHKEQDMILAVPEGAYAVRLGNDATIRQRISVTRHMYYSVTFSAARTCAQAEKLNVSVTLEFGVLPIQTVYTSTGWDSYSWAFKAEHSAVWLSIHNPGVEEDPACGPLIDLVAIKTLPPPHHTRGGTMLRNGDFEEGPYIFADTPWGVLVPPMDEDVHSPLPGWMVMSTTKVVKYVDSARHAVPSGAHAVEMVAGRECALVQEVATVPGRRYTLSFSVGDAGNGCIGSLAVDAYAARATLKVSYESRGTGGHERAELVFAAVANRTRVVFHSSNHHMKSDGTLCGPVVDDVSLVSVDKHTVRRLLM

SEQ ID NO: 12247 - protein, 370 aa, Prunus armeniaca
TNEVPSIANYDRKSEVKTFDDTKEGVKGLVDAGITKVPRIFHLPVDQYPINNTCDSEPTKTQLRIPVIDLEGLEYDNSPTKRKETVAKVGEASETWGFFQIANHGIPVDVLEEIKNGVRGFFEQDTEVKKKYYTRDRFRPVIYNSNFDLYSAPATNWRDTFLCNMAPNPPKPEDLPQVCRDILVEYSKQVMKLGKLLFELLSEALGLKPSHLNDMDCSLGLQILGHYYPPCPQPELTLGTSKHADNDFITVLLQDHIGGLQVLHQNTWIDVLPVPGALVVNIGDLLQLISNDRFRSVEHRVLANRACPRVSVACFFSTGFLALPRIYGPIKELLSEDNLPKYRETTVKDYNAHHYNKGLDGTCALTHFKL

SEQ ID NO: 12248 - protein, 902 aa, Lycopersicon esculentum
MNSAMSSSSSFMVASSCCQNLQTRKYFLLAPEPFEKIGMIDALQKYNRKERKVFISSHLVPGHLDASGTRKKFLHEPVPKLEFVRTLLIDNYDSYTYNIFQELSIINGMPPVVIRNDEWTWKEVYHYLYEERTFDNIVISPGPGSPTCPSDIGICLRLLLECIDIPILGVCLGHQALGYVHGAEVVHAPEPFHGRLSDIEHNGCQLFHEIPSGRSSGFKVVRYHSLVIDPKSLPKELIPIAWTSTAETLPFQGVKRSNSFLNASKENKDIFNGMSELSDDSKDVKGGKVLMGIMHSSRPHYGLQFHPESVATCYGRQLFKNFRKITEDYWLLLMSTSFNERRAHYAACMQVPNLDPLSRSVAKRGHLVNKLIERRTAEVDGTLNLSHPGHSVKFLKMTWKKLDCSASQVGGADNIFCELFGDQEAKNSFWLDSSSIEKERARFSFMGGKGGSLWKQLSFRLSNRSDRMCKGGGHLSVEDANGHVISKFLEDGFFDYLDKELLSFCFDEKDYEGLPFDFYGGYIGYIGYDLKAECGVASNRHRSKTPDACLFFTDNVIVIDHQYDDIYTLSLHDGSTSTTSRLEDLEQRLLNLRAFTPRRLQSQASRGFSVVELKSGFSAEKSREQYIKDVENCQEFIKEGESYELCLTTQMRMKLGGIDSLELYRNLRIRNPAPYAAWLNFSRENLSICCSSPERFLRLDRNAILEAKPIKGTIARGSTPKEDEFLKLQLECSEKDQAENLMIVDLLRNDLGRVCETGSVHVPHLMEIESYATVHTMVSTIRGKKRSDASAIDCVRAAFPGGSMTGAPKLRSMELLDHLENCSRGIYSGCIGFFSYNQAFDLNIVIRTVVIHEGEASVGAGGAITALSDPNDEYEEMLLKTRAPIKAVLEHQSSIFSSDAQK

SEQ ID NO: 12249 - protein, 266 aa, Photorhabdus luminescens
MNKKILILPGDGIGQEVCDAALPVFQALNLPVTLEIGDIGWTCWERDGDPVPASTWEKIASVDAVLLGAITSKGKEEAQQALPPHLRVKTRNYVSPVIQLRQRLGLYANIRPVRYVEGDRKPFRCCVIRENTEGLYAGFDFKGIPSTATTWLQHPNIDKYGPEEAAWTVRLQTRFGLERLFITAFEYAKENNYSRVTFADKPNVMRESGHFAKGIFDTVAAHYPEIKADIHNIDAVALWMVKKPHEFGVIVSENMFVIFCLIWQRA

SEQ ID NO: 12250 - protein, 473 aa, Synechococcus sp. WH 7803
MASTAQDVLRQIKDEGIELIDFKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHELAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 12251 - protein, 427 aa, Batrachospermum gelatinosum
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEQMYERAEFAKELGSIICMIDLVIGYTAIQSMALWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 12252 - protein, 689 aa, Oryza sativa
MAPLRTLVIFLLLLLALVPALSRPDGGGGGFYDPARVTQLSWRPRAFLYSGFLSHDECDHLVNLAKGRMEKSMVADNDSGKSIMSQVRTSSGTFLSKHEDDIVSGIEKRVAAWTFLPEENAESIQILHYELGQKYDAHFDYFHDKNNLKRGGHRVATVLMYLTDVKKGGETVFPNAAGRHLQLKDETWSDCARSGLAVSMLTRQRIQPVFMEAVRNPKYMVGTKDSLGFCRKSCGPERRFVRRQFAGAPPRVSPTDLPAPAPPRPPPPPAAGNQGGNASANASATQAVAAPAVFRHPGRAMPWAGEGGDTLFREIDATMEMRRLLVLFALLSVTAVVPVFLWPDKKGGASDVAVVVAAPPFNASSVTIISWKPRIFFYKGFLSDDECDHLVKLGKEKLKRSMVADNESGKSVMSEVRTSSGMFLDKQQDPVVSGIEERIAAWTLLPQENAENIQILRYENGQKYDPHFDYFQDKVNQLQGGHRYATVLTYLSTVEKGGETVFPNAEGWESQPKDDSFSDCAKKGLAVKGDSVLFFNLQPDGTPDPLSLHGSCPVIEGEKWSAPKWIHESESKKKKKKKKKRVRKPRRPPVAAMRRPAGSSSAAALAMAILLGVLVLMALVMDGGEKTGAPAIAAGRRMLVGAADAGQMRTLEDFKADDPFQDSKRRVPNGPDPIHNRGTGKSGRSPGRA

SEQ ID NO: 12253 - protein, 753 aa, Rhodospirillum rubrum
MADETNRNLDREALLFHITGRPGKIEIAATKPLTTQRDLSLAYSPGVAAPCLAIQRDPTTAYDYTAKGNMVAVISNGTAVLGLGDLGALASKPVMEGKAVLFKKFADVDGIDLEVDTRDVDEFVNCVRYLGPTFGGINLEDIKAPECFIIEQRLRALMDIPVFHDDQHGTAIIAAAGLINALDLSGRDIGDAKMVVNGAGAAAIACVELVKAMGMRSANVTLCDSKGVVHRGRSDLNQWKSAHAIDTEARSLQDAMRGADVFLGLSVKGAVTAEMVATMAPQPIIFAMANPDPEITPEDVLSVRDDAIIATGRSDYPNQINNVLGFPYIFRGALDVRARTINDEMKIAAARAIAALAREDVPDEVAAAYSGRRLRYGRDYIIPVPFDPRLIAAISPAVAEAAMRSGVARKPIIDIIGYRRELSARLDPTAASLQALSAQVINNPKRVAFAEGEEEKMIRAALSYRNAGYGTPILIGRAEKIAATMAAMGLGGLEGMEIQNAKLSTQTKPYTDYLYGRLQRHGYLYRDVQRLVNSDRNVFAASMVMLQDADAMVTGTIRHFHSCLSDITKVIDQTPGELVFSVTLLIARGRTVFIADTNVHEAPSAQELADIAIQTAALARRMGHEPRVALLSYSTFGAPLGRTPDRPRQAVALLEDRKVEFEFDGEIGVHVALDPDLLKLYPFCRLSAPANVLIMPGLHSANISSKLMQKMGGATTIGPVLMGLSRPCQIVPMDATVSDIVHMATLAAAEAGR

SEQ ID NO: 12254 - protein, 494 aa, Sphingomonas sp.
MTSVSSSPITDTILNFIDGSYREGSEGKSFSNVNPATGAEIGVVHEASQADVADAVAAAKAALTGPWGKMTTAERVKLITAVATEIERRADDFLAAEVADTGKPRHVASHIDIPRGAANFRMFADVVSTMPGESFNTPTPDGGQAFNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLGYYRRAVEDGATVVTGGGVPEISGAEAGGFFVEPTLWIDVAHGDTVMREEIFGPCCGILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 12255 - protein, 690 aa, Oryza sativa; identical to SEQ ID NO: 4516

SEQ ID NO: 12256 - protein, 306 aa, Escherichia coli O157:H7 EDL933
  unsure (1)..(306): unsure at all Xaa locations
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGXTLSKIEWLALGVIVFAVVLVTLGKYLFPAKPVVAPVIQDASSE

SEQ ID NO: 12257 - protein, 515 aa, Zea mays
  unsure (1)..(515): unsure at all Xaa locations
MDALPEAWSQVRAPVIVPLLRLAVAVCLTMSVLLFLERVYMAVVISGVRLLRLRPDRRYRCDPLPEDDPELGSSAFPVVLVQIPMFNEREVYQLSIGAVCGLSWPADRLVVQVLDDSTDEVIKEMVRMECERWARKGINITYQIREDRKGYKAGALRAGMRHAYVRDCEYVAIFDADFQPDPDYLKRTIPYLVHNPEIALVQARWRFVNADECLMTRMQEMSLDYHFTVEQEVSSSVCAFFGFNGTAGVWRISAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCVIIPATIFVPEVRIPKWGXCVYIPSAITLLNSVGTPRSFHLLFFWVAFENVMSLHRTKATLIGLLEAGRANEWVVTAKLGSAMKMKSANKAGLRKQFMRIWERLHVTELGVAAFLFSCGWYDLAYGRDHFFIYLFFQSVAFFIVGVGYVGTIVPQS

SEQ ID NO: 12258 - protein, 228 aa, Buchnera aphidicola str. Sg (Schizaphis graminum)
MKKFFLASSILSADFARLGEDTKKAIDAGSDWIHFDVMDNHYVPNLTMGPMILKALRNYNITVPIDVHLMVKPVDNLIPQFAEAGADFITFHPESTDHIDRTLNLIKECGCKAGLALNPATSLNFLDYVMEKLDLILLMSVNPGFGNQSFLPTSFNKLREVRKKIELNSSNILLEVDGGVKLENISEVAFSGANVFVIGSGIFGYTDYNVIIKKIRKKLKNVYSTSIH

SEQ ID NO: 12259 - protein, 350 aa, Schizosaccharomyces pombe
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKACTNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 12260 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAATRFGLSLVRALQGEQGVVECAYVEGDGQYARFFSQPLLLGKNGVEERKSIGTLSAFEQNAL

SEQ ID NO: 12261 - protein, 487 aa, Pseudomonas sp. TW3
MRETKEQPIWHGKVFSSNWVEAQGGVANVVDPSNGNIIGVTGVANGKDVDAAVNAAKRAQKEWAAIPFSERAAIVRMAAEKLKEREHEFADWNVRECGAIRPKGLWEAGIAYEQMHQAAGLASLPNGTLFPSAVPGRMNLCHRVPVGVVGVIAPWNFPLFLAMRSVAPALALGNAVILKPDLQSAVTGGALIAEIFSDAGMPEGVLHVLPGGVDVGESMVANSGINMISFTGSTQVGRLIGEKCGRMLKKVALELGGNNVHIVLPDADLDGAVRCAAWGTFLHQGQVCMAAGRHLVHRDVAQQYAEKLALRANNLVVGDPNSDRVHLGPLINDKQVVRVHALVESAQRAGAKVLAGGTYQDRYYQATVIMDVKPEMEVFKSEIFGPVAPITVFDSIEEAIELANSSEYGLAASIHTTALATGLDIAKRLNTGMVHINDQPINCEPHVPFGGMGSSGSGGRFGGLASIDEFTQSQWISMVEKSASYPF

SEQ ID NO: 12262 - protein, 339 aa, Enterococcus faecalis V583
MEKANLDWNNLGFSYIKTPFRYISYWRDGKWEEGTLTDNNQLTISEGSPALHYGQQCFEGLKAYQCADGSVNLFRPDENAKRLQKSCARLLMPQVPVETFVSACQEVVKANLAYLPPYGTGGTLYLRPYMIGVGDNIGVAPAKEYIFSIFCVPVGSYFKNGLAPTNFIVSEYDRAAGRGTGAAKVGGNYAASLLPGAEAHEKEFSDCIYLDPYTHTKIEEVGAANFFGITKDGTFITPKSASILPSITKYSLLTLAKERLGMTALEGDVYIDRLADFSEAGACGTAAIISPIGGIQNGTDFHVFYSETEVGPVTKQLYDELVGIQFGDKEAPEGWIVKV

SEQ ID NO: 12263 - protein, 410 aa, Oryza sativa
MALWKLEPNLPFVAECHLQRVGRREQPRARDSREGSHGMTGSARSVVALLFLLVGSAARADSAVTDGLLPNGNFEDGPDKSQLNGTVVTGRYAILNWEISGFVEYIESGHREQDMILAVPEGARAVRLGNDATIRQRLSVTRRAYYSITFSAARTCAQKEKLNMSVTPEFGVLPIQTVYTSSGWDSYSWAFRAKHSVVWLSIHNPGEEEDPACGPLIDSIAIKNLYPPPRTKGNMLRNGDLEEGPYIFPDATWGVLVPPIFEDEHSPLPGWMIMSDTKVIKYVDSPHHRVPQGARAVELVAGRETALVQEVATVPGRSYRLSFSVGDAGNGCKDSLAVEAYAARATAKVPYESQGTGGHKRAQLEFAAVANLTRVVFQSFNYHTKPDGTLCGPLVDDISLVSVRKRAARL

SEQ ID NO: 12264 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 12265 - protein, 285 aa, Fusobacterium nucleatum subsp. vincentii ATCC 49256
MRRYKMDTRFNGGVIMDVTTKEQAIIAEEAGAVAVMALERIPADIRAAGGVSRMSDPKLIKEIMSAVKIPVMAKVRIGHFVEAEILQAIGIDFIDESEVLSPADSVYHVNKKNFSTPFVCGARNLGEALRRICEGAKMIRTKGEAGTGDVVQAVSHMRQIMKEINLVKALREDELYVMAKDLQVPYDLVKYVHENGRLPVPNFSAGGVATPADAALMRRLGADGVFVGSGIFKSGDPKKRAKAIVEAVKNYNNPEIIAKVSEDLGEAMVGINENEIKIIMAERGV

SEQ ID NO: 12266 - protein, 458 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 12267 - protein, 404 aa, Haemophilus somnus 129PT
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 12268 - protein, 538 aa, Triticum aestivum
  unsure (1)..(538): unsure at all Xaa locations
PAEPASHVKDPGKPPVNDAPSSATKLMVPAAKQYIENHYKTQMKSLQDRKERRWMLERKLXNAEVPAEEQNNILKHLEKKETEYMRLQRHKMGVEDFELLTIIGRGAFGEVRLCREKTSKSVYAMKKLKKSEMLRRGQVEHVKAERNLLAEVDSAYIVKLYYSFQDDEFLYLIMEYLPGGDMMTLLMRKDTLTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 12269 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 12270 - protein, 502 aa, ASPERGILLUS NIDULANS FGSC A4
MKPPYYMETGCKRNPGSDSTLKVRWTLYTRLLQSANQGLGIDPGSGQVFASCPTNTVADVDAYVSSAHRSFLSYRETNPRARAKMLLNWHNLIAQSKNDIAKLVVYETGKPMAEAVGEVDYALGFAWWFAGEAERVRGSIAQPSISERRTFVIKQPIGVCIALVPWNFPVAMIIRKAAAALAAGCTVVIKPSPETPLSVLALADLALQAGFGPGVINVLTTDNLNTPDVSEALCKHPLVRKVTFTGSTAVGQLIARHCSEGLKKVTLELGGNCPFIIFDDGDLEQALAALMILKWRTAGQACTHANRVYVQSGVYDTFLRMIVNATKQLKVGHGASPGTTMGPLTTSRGIEKLERHVADALAKGARLELGGHRLQLEGNYFQPTIISGMSAYMLTTQEEIFGPLLGLYRFETEEEAVRMANDTSMGLASYFFTRDVSRTWRLLENLEAGMIGMNTGNSSAAESPFGGIKASGYGKEAGKDVAIEEYLIAKTGTLTVGAVSKL

SEQ ID NO: 12271 - protein, 469 aa, Pseudopleurochloris antarctica
KSDRYESGVIPYAKMGYWDADYNVKHTDILAMFRITPQPGVDPVEAAAAVAGESSTATWTVVWTDLLTACDIYRAKAYRVDPVPGTTDQFFAYISYECELFEEGSLANLTASIIGNVFGFKAVKALRLEDMRIPYAYLKTFQGPATGLIVERERMDKFGRPFLGATVKPKLGLSGKNYGRVVYEGLRGGLDFLKDDENINSQPFMRWRERFLYCMEGVNRASAATGEVKGSYLNTTAGNMEEMYTRAEYAKQVGSIIVMIDLVIGYTAIQSMAIWARANDMILHLHRAGNSTYARQKNHGINFRVICKWMRMSGVDHIHAGTVVGKLEGDPLMVKGFYNVLLDTKHTINLSQGLFFDMDWASLRKTVPVASGGIHCGQMHQLTYYLGDDVVLQFGGGTIGHPDGIQAGATANRVALESMVLARNEGRDYLNEGPQILRDAAKMCGPLKTALDLWKDITFDYTSTDTPDF

SEQ ID NO: 12272 - protein, 218 aa, Aspergillus niger
MSSTSPSKEPEVEPEVQSGEDQEQMDKEQQDTQAQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPTSSGYGAGAPVGAPGPAGPGGRPMAPGAGFPDTADSANNIMNQSLDPSEQDTSTYGYPPMVGQPHNGTAGESY

SEQ ID NO: 12273 - protein, 311 aa, Arabidopsis thaliana
MGCSFSGLNALYDAVNGGGDVWINENRFRIDPAHLSADGTYAMKKVLIQNKEQLELVREEIRVSSLFNHPNLLPLLDHAIISVKDGQEGAWKHEAFLLFPVHLDGTLLDNFTLMKAKKETFSTTDVLHIFRQLCDGLKHMHSLEPPYAHNDVKPGNVLLTRRKGQPPLAILMDFGSARPSRKQIRSRQEALQLQEWTSEHCSAPFRAPELWDCPSHADIDERTDIWSLGCTLYAIMYGVSPFEYALGESGGSLQLAIVNAQIKWPNTGPKASYPEALHQFVTWMLQPQAAVRPRIDDIIIHVDKLIAKFTK

SEQ ID NO: 12274 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 12275 - protein, 276 aa, Triticum aestivum
PRVRPDTFIFAILLPMQIALSFVRSLSSLSPFSIFADACNVLAMAIVIKEDIRLFDHPFADRSAFNGLWAIPFSFGVALFCFEGFSMTLALEASMAERKKFKWVLSQALVCIMFVYACFGVCGYLAYGEATKDIVTLNLPTSWSSSAVKIGLCIALAFTFPVMMHPIHEIVEARIRSSRCFQKFSQNVGGPNWLALHASRIMVVIILAVVASYVPAFGAFIAFVGSTVCALLAFVLPTAFHLSIVGSSMSLWRRLLDYGFLLFGLVFVVYGTFTAL

SEQ ID NO: 12276 - protein, 527 aa, Emericella nidulans
MADAVIAGQRVEAPVTWKAYLMCVFAAFGGIFFGYDSGYINGVMGMDYFIQEFTGKVKSETPAAQFVISSSNKSLITSILSAGTFFGAIIAGDLAEWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 12277 - protein, 137 aa, Pectobacterium carotovorum subsp. carotovorum
LFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLS

SEQ ID NO: 12278 - protein, 113 aa, Glycine max
  unsure (1)..(113): unsure at all Xaa locations
MASSMIWSAAVTTVNRAGAGMVAPFTGXLKSLLGFPTGRPTIAFTSMVGTVGGVHCLQVWPPIARKKFGTLSYLPDLDDAQLAKEVEYLLRKGWIPRLEFELEHGFVYREHNR

SEQ ID NO: 12279 - protein, 471 aa, Gelidium micropterum
  unsure (1)..(471): unsure at all Xaa locations
SGVIPYAKMGYWDPDYAVKETDVLALFRVTPQPGVDPVEASAAVAGESSTATWTVVWTDLLTACDLYRAKAYKVELVPNTTDQYFAFVSYDIDLFEEXXXXXXXXXXXXXXXXXXAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPLMIKGFYNTLLLTHLEANLPQGIFFEQDWASLRKVTPVASGGIHCGQMHQLLDYLGVDVVLQFGGGTIGHPDGIQAGATANRVALEAIVIARNEGRDYVAEGPQILRDAAKTCGPLQTALDLWKDISFNYTSTDTADFVETPTANV

SEQ ID NO: 12280 - protein, 474 aa, Botrydiopsis intercedens
  unsure (1)..(474): unsure at all Xaa locations
RYESGVIPYAKMGYWDADYNVKHTDILALFRITPQPGVDPVEAAAAVAGESSTATWTVVWTDLLTACDIYRAKAYRVDPVPGTTDQFFAYIAYECELFEEGSLANLTASIIGNVFGFKAVKALRLEDMRIPFAYLKTFQGPATGXXXXXXXWTKFGRPLLGATVKPKLGLSGKNYGRVVYEGLRGGLDFLKDDENLNSQPFMRWRERFLYCMEGVNRASAATGEVKGSYLNCTAGTMEEMYERAAYAKITGTIIVMIDLVIGYTAIQSMAIWARKNDMILHLHRAGNSTYARQKNHGINFRVICKWMRMAGVDHIDAGTVVGKLEGDPLMVKGFYNTLLDTKLDINLPQGLFFQMDWAALRKVVPVASGGIHCGQMHQLLYYLGXXXXXXXGGGTIGXPXGIQAGATANRVALEAMVLARNEGRDYLNEGPQILRDAAKMCGPLKTALDLWKDITFDYTSTDTPDFVETATESK

SEQ ID NO: 12281 - protein, 353 aa, Bacteroides fragilis
MDFKIAVLAGDGIGPEISVQGVEVMSAVCEKFGHKVNYEYAICGADAIDKVGDPFPEETYRVCKNADAVLFSAVGDPKFDNDPTAKVRPEQGLLAMRKKLGLFANIRPVQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDCKAEGALIRKAVDASLDANVRTPEIQVEGGEKFGTKEVGAWIVDYIRKA

SEQ ID NO: 12282 - protein, 522 aa, Ricinus communis
MAGGSLAPAGVAKERAEQYQGKVTFAVFVACMVAAVGGSIFGYDIGISGGVISMDAFLEKFFRSVYLKKKHAHENNYCKYDDQRLAAFTSSLYLAGLAASLVAGPITRIYGRRASIISGGISFLIGAALNATAINLAMLLLGRIMLGVGIGFGNQAVPLYLSEMAPTHLRGGLNIMFQLATTSGIFTANMVNYGTHKLESWGWRLSLGLAAAPALLMTIGGLLLPETPNSLIEQGLHEKGRNVLEKIRGTKHVDAEFQDMLDASELANSIKHPFRNILEKRNRPQLVMAIFMPTFQILTGINIILFYAPPLFQSMGFGGNAALYSSAVTGAVLCSSTFISIATVDRLGRRFLLISGGIQMITCQVIVAIILGVKFGDNQQLSKSFSVLVVIMICLFVLAFGWSWGPLGWTVPSEIFPLETRSAGQSITVAVNLFFTFVIAQSFPSLLCAFKFGIFLFFAGWVTVMTAFVYIFLPETKGVPIEEMIFLWRKHWFWKKIVPGQPEVDDSRESMEMGEAVASRIK

SEQ ID NO: 12283 - protein, 290 aa, Zea mays
MKPPSSPGCTSLFLLPCILLAAVMYLVLFPDNFRLPAGMFGSSTSSSCNDNNGASAVGRLAAGGSPPTDEAVDLRLLMGIVTTPSTYERRALLRLAYSLQPRPVRAVVDVRFVMCRIEREEDRILVALEIIAHGDVVVLNCTENMNDGKTYAYFSAVPGLFAGDGERYDYVGKTDDDTYYRVAALAESLRGKARRDAYQGYLTPCHWLPEKQYMSGMGYVVSWDVAEWIAATPELRDDHNDWEDVNFGGWLRKGGRYKNVYNEEPRMYDYWDREMATDVNCFRHEHIGRH

SEQ ID NO: 12284 - protein, 141 aa, Zea mays
MAGASAVAVLPVATPAAPRRGGAGPCSCLAPRGSSFYRRMNCRRDSPSAAAPTRRRVVARLSGRDPGEAGTDAGVGQILKGDDSGYLWTLVLGSLGGAAVIKYGSILLPDITRPNIVVALLMVSLPVVAAVLALLKASSVD

SEQ ID NO: 12285 - protein, 278 aa, Cladonia rangiferina
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 12286 - protein, 528 aa, Oryza sativa
MAGGQLNVLSKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 12287 - protein, 312 aa, Photobacterium profundum
MKVAVIGAAGGIGQALALLLKNGLPAGSDLALYDIAPVTPGVAADLSHIPTPVSIKGYGGVDPTPALEGADVVLISAGVARKPGMDRSDLFNVNAGIIKSLAEKIAVVCPKACVGIITNPVNTTVAIAADVLKKAGVYDKRRLFGITTLDIIRSETFVAELKGKTPSDIQVPVIGGHSGVTILPLLSQVEGVEFSDEEIKALTPRIQNAGTEVVEAKAGGGSATLSMGQAAYRFGLSLVRALQGEQGIVECAYVEGDGKHARFFAQPVLLGKDGVEEVIDYGKLSTFEQEALNNMLDTLTSDITLGEEFAAK

SEQ ID NO: 12288 - protein, 533 aa, Oryza sativa
MAGLTVKLAPRDQFALPSVHTFFSLSCRLPSIATKAVRNFEFLVSWRGQQKGREYGDGANSIAAPVFVRLVLGAIFVLVGQWEGYAFFFFFFFFFFFFFFFFFFFFFFSGDVYCGHRHFRRRRRRRQWDGRLVFGSSGASACCDRSAPPFPPRAGHRRRPRLHRHRHDLPFHALRLDTMAAISPEHRRQDAAKGIKLVPILSRFNSVKMSRKRLVGMFEYPSLEAATEKFSESNMLGVGGFGRVYKAAFDAGVTAAVKRLDGGGPDCEKEFENELDLLGRIRHPNIVSLLGFCIHEGNHYIVYELMEKGSLETQLHGSSHGSTLSWHIRMKIALDTARGLEYLHEHCSPPVIHRDLKSSNILLDSDFNAKIADFGLAVSSGSVNKGSVKLSGTLGYVAPEYLLDAAMSISGKLTEKSDVYAFGVVLLELLMGRKPVEKMSPSQCQSIVTWAMPQLTDRSKLPSIVDPVIKDTMDPKHLYQVAAVAVLCVQAEPSYRPLITDVLHSLVPLVPTELGGTLRAGEPPSPNLRNSPC

SEQ ID NO: 12289 - protein, 509 aa, Arabidopsis thaliana
MDAQSVSEKLRSSGLLRTQGLIGGKWLDSYDNKTIKVNNPATGEIIADVACMGTKETNDAIASSYEAFTSWSRLTAGERSKVLRRWYNLLSRSEPLHFTKHRYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 12290 - protein, 142 aa, Oryza sativa
DPPCAVDGCKEDLSKCRDYHRRHKVCEAHSKTPLVVVSGREMRFCQQCSRFHLLQEFDEAKRSCRKRLDGHNRRRRKPQPDPMNSASYLASQQGARFSPFATPRPEASWTGMIKTEESPYYTHHQIPLGISSRQAAFRWLHL

SEQ ID NO: 12291 - protein, 354 aa, Pseudomonas fluorescens PfO-1
MALISMRQMLDHAAEFGYGVPAFNVNNLEQMRAIMEAADKTDSPVIVQASAGARKYAGAPFLRHLILAAIEEFPHIPVCMHQDHGTSPDVCQRSIQLGFSSVMMDGSLGEDGKTPTDYEYNVRVTQQTVAMAHACGVSVEGELGCLGSLETGMAGEEDGIGAEGVLDHSQMLTDPEEAADFVKKTQVDALAIAIGTSHGAYKFTKPPTGDVLAIDRIKEIHKRIPNTHLVMHGSSSVPQEWLAIINQYGGDIKETYGVPVEEIVEGIKHGVRKVNIDTDLRLASTGAMRRLMATNPSEFDPRKFFGETVKAMRDVCIARYEAFGTAGNASKIKPISLEAMFQRYLKGELNAKVN

SEQ ID NO: 12292 - protein, 297 aa, Glycine max
MSLSLLRIYSSPHLLSSSLFFPTPPLSSFLPKLPNAPRTPHIVLCHRRDASSASKQRVPEDTEYEQPMRTSYDDDEEEEEEFLGSLVLPERWDVLGLGQAMVDFSGMVDDNFLKNLGLEKGTRKVVNHEERGRVLQAMDGCSYKAAAGGSLSNTLVALARLASRSQKVPAINVAMTGSVGSDLLGGFYREKLRRANVQFLSAPMKDGTTGTVIVLTTPDAQRTMLAYQGTSSTVNYDASLASAVSKTNILVVEGYLFELPDTIKAITKACEKARTNGALVAITASDVSCIERHFDDF

SEQ ID NO: 12293 - protein, 333 aa, Pseudomonas syringae pv. syringae B728a
MIKLDGTSDKSRLGGNAILGVSLAVARAAASALNLPLFQYLGGEQAARMPVPMFNILNGGVHANWQGPDFQEFMIAPTGAGSFKEALRWGSEVYHELKAVLKDAGYSTAVGDEGGFAPALKKNSDAIELIIKAIERAGYTPGSQIEIAIDPASSGFYENGLYHLRSEGRKVDAQELINLYSSWVDKYPIAVLEDGLAEDDWSGWKLLNAALGDRIELVGDDLFVTNVERIQRGITENVANAVLIKPNQIGTLTETKAAIEMAYGANWGAMVSHRSGETVDSSIADLTVAMGTGHLKTGAPCRGERVEKYNQFLRIEEDLGSRAFYAGHDAFVR

SEQ ID NO: 12294 - protein, 494 aa, Oryza sativa
MRKAAAAAVAAAAAVGVALLVRRQLREAKRWGRADAVLRELEERCAAPPGRLRQVADAMAVEMHAGLASEGGSKLKMIISYVDALPSGEEKGVFYALDLGGTNFRVLRVQLGGKEGRVIKQEHDEISIPPHLMTGGSNELFDFIASSLAKFVASEGEDFHLAEGRQRELGFTFSFPVKQTSIASGTLINWTKGFSIDETVGEDVVTELTKALERQGLDMKVTALINDTIGTLAGGRYDDNDVIAAVILGTGTNAAYVERANAIPKWHDLLPKSGDMVINMEWGNFRSSHLPLTEFDQALDAESLNPGEQVYEKLISGMYLGEIVRRVLLKMAEEASLFGDEVPPKLKIPFIIRTPYMSMMHCDRSPDLRTVGAKLKDILGVQNTSLKTRRLVVDVCDIVAKRAAHLAAAGIHGILKKLGRDVPNTDKQRTVIAVDGGLYEHYTIFAECVESTLRDMLGEDVSSTIVIKLAKDGSGIGAALLAAAHSQYREAEEL

SEQ ID NO: 12295 - protein, 308 aa, Salmonella typhimurium
TTKKADYIWFNGEMVRNEDAKVHVMSHALHYGTSVFEGIRCYDSHKGPVVFRHREHMQRLRDSAKIYRFPVSQSIDELMEACRDVIRKNNLTSAYIRPLVFVGDVGMGVNPPPGYTTDVIIAAFPWGAYLGAEALDQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDPVNS

SEQ ID NO: 12296 - protein, 181 aa, Nicotiana sylvestris
MAFLIMSSAAAVATGTNAAQASMIAPFTGLKSATSFPVSRKQNLDITSIASNGGRVQCMQVWPPINKKKYETLSYLPDLSEEQLLREVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 12297 - protein, 213 aa, Glycine max
  unsure (1)..(213): unsure at all Xaa locations
MSRRYDSRTTIFSPEGRLYQVEYAMEAIGNAGSAIGILSKDGVVLIGEKKVTSKLLQTSTSSEKMYKIDDHVACAVAGIMSDANILINTARVQAQRYTFMYQEPMPVEQLVQSLCDTKQGYTQFGGLRPFGVSFLFAGWDKNHGFQLYMSDPSGNYGGWKAAAVGANNQGXQSILEQITRMVXTREEXXELXXKVLSKXLAGXXWXPKXLXXG

SEQ ID NO: 12298 - protein, 485 aa, Bacillus subtilis subsp. subtilis str. 168
MFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 12299 - protein, 355 aa, Spirulina platensis
MTQNYRITLLSGDGIGPEIMAVAVDVLKAVGKQLDLNFEFKEALMGGVAIDATGEPLPEESLQACRDSDAVLLAAIGGYKWDNLPRPERPETGLLALRAGLGLFANRARLLFCPHVLDASSLKREVVEGVDIMVVRELTGGIYFGQPKGIFETETGKNEGSNTMAYGESEIDRIGRVGFETAKKRQGRLCSVDKANVLDVSQLWRDRIMALAADYPEVELSHLYVDNAAMQLVRWPKQFDTIVTGNLFGDILSDAAAMLTGSIGMLPSASLGASPGGVFEPVHGSAPDIAGQDKANPLAQVLSAAMMLRYGLDEPAASDPVEKAVLKVLDWGYPTGDIMSEGMKAVGCRKWGICY

SEQ ID NO: 12300 - protein, 170 aa, Helicobacter pylori
GSGMHTHVSVWKNKENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 12301 - protein, 430 aa, Penicillium chrysogenum
MSSGGDVNQAEKSVFGMPGFVVDFLMGGVSAAVSKTAAAPIERIKLLIQNQDEMHKQGRLDRKYNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTHNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTLATDGIAGLYRGFGPSVLGIVVYRGLYFGMYDSIKPVLLVGPLEGSFLASFLLGWTVTTGAGVASYPLDTVRRRMMMTSGEAVKYNSSMDAARQIVAKEGVKSLFKGAGANILRGVAGAGVLSIYDKAQMLLLGKKF

SEQ ID NO: 12302 - protein, 325 aa, Vibrio fischeri
CRIGRSVLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKMLVWYDNEFGITSEFAAAC

SEQ ID NO: 12303 - protein, 163 aa, Corynebacterium glutamicum ATCC 13032
MMPAQNKNLPGSVIVVSDRIKSGERIDKAGPVAVDLLQESGVEISTFTVVEEGFEPVHQELVKALARRDRVIITIGGTGVGPRNRTPEATEPHIDTLLPGLMTQILFSGLSNTAQAGLSRGLVGLSARDSTAALIVNAPSSSGGVRDALGVVCPLFGSIFERL

SEQ ID NO: 12304 - protein, 295 aa, Lycopersicon esculentum
MTYMFKYDSVHGQWKHHELKVKDEKTLLFGEKAVTVFGFRNPEETSMDRLGADYIVESTGVFTDKDKPAAHLKGGAKKFIISAPSKDAPMFVVGVNEKEYNPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRPSIFDAKAGIALSKNFVKLVAWYDNEWGYSTRVVDLIIHMSSVQ

SEQ ID NO: 12305 - protein, 250 aa, Zea mays; identical to SEQ ID NO: 984

SEQ ID NO: 12306 - protein, 359 aa, Zea mays
VRWRPWWRRWRQGWWRWQAGGDAAAGWCGACTGAFARFCGGCGRSGPGAAGGSASTTTRSATRSTSTTAAPPPPRPPPRPTSSLPPATTTRYGESASDDQTSLPKRTNPPPHHPWATGTGAPQSRTPKPHPAPIMDAADARPSAPSAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEETEDENEESNPSLTPNPANSNPTFSQDQRSNEQQHTPQHGQRVSFQLNAVAAAAAAAKRPRMTVDQLNIG

SEQ ID NO: 12307 - protein, 140 aa, Triticum aestivum
  unsure (1)..(140): unsure at all Xaa locations
MAPTVMASSATSVAPFQGLKSTAGLPVSRRSNGASLGSVSNGGRIRCMQVWPIEGIKXFETLSYLPPLXTEALLKQVDYLIRSKWVPCLXSTSWVHLPVEHNASPGYYDXRYWTMXELLCFGCTDAXQVXNEVEEVKKDT

SEQ ID NO: 12308 - protein, 175 aa, Glycine max
  unsure (1)..(175): unsure at all Xaa locations
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 12309 - protein, 204 aa, Oceanobacillus iheyensis HTE831
MLLIIDNYDSFTYNLVHYLEKLSIELMVIKNDQITIKEIAELDPDYILLSPGPHNPDQAGITLDVITFFHDKIPILGVCLGHQAIGQAFGANIIKTTPMHGKRSTISHDVKTVFKDIPSPYLVTRYHSLVIERTSLPEELVITSVSEDGEIMGVRHTTFPIEGVQFHPESIWTEYGEILLHNFLTHYANYKERRNDATRRKIDI

SEQ ID NO: 12310 - protein, 161 aa, Lilium sp.
FLRSISMGSKLTREEYNTLLAAFHKLMVRLEVASVPKDATPADIKNLPDAYLYFIDMPGVRTGEIKVEVEDDSDLVISGGRKREEEEKYQIMERWTGRRMRKFELPKNADTKAVSAVWKNGVLAVTVGKLLAWEVAGLFFNIERLPVPLPTKTKSIEVKIA

SEQ ID NO: 12311 - protein, 116 aa, Oryza sativa
MFALHQSVRTSFSFLNICCSSQVLGRKYFRLYSASISNDLYPHRETMLSNISQVDLDNINVNEFPRTGDVEFMDGILEEGDLLYIPPKWWHYVRSLSTSFSVSFWWRTSIPPPQGS

SEQ ID NO: 12312 - protein, 563 aa, Saccharomyces cerevisiae
MSEITLGKYLFERLSQVNCNTVFGLPGDFNLSLLNKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIRNAPAEIDRCIRTTYTTQRPVYLGLPANLVDLNVPAKLLETPIDLSLKPNDAEAEAEVVRTVVEFIKDAKNPVILADACCSRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVAKDYKPVAVPARVPITKSTPANTPMKQEWMWNQLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 12313 - protein, 246 aa, Glycine max
MDGDVSAALKKAKLIKLKLEALERSNAANRNLPGCGPGSSSDRTRTSVVNGLKKKLKDSMESFNEIRGLVSSEYRETVQRRYFTVTGENPDDKTLDLLISTVWSIWEKMAAPTPIHKTEEEWKVILSPEQFRILRQKGTELKGTGEYNKFFEEGIYNCAGCGTPLYKSSTKFDSGCGWPAFFEGFPGAINRTPDPDGRRTEITCAACGGHLGHVFKGEGFKTPTDERHCVNSISVKFVPGSATFSI

SEQ ID NO: 12314 - protein, 297 aa, Carica papaya
MAKLSCVLMAPLLFSFLLILMVSSQGPPSPGYYPTSRFPSLGFDQGFRNRWGPQHQRVEQGVLTIWLDSTSGSGFKSLHTYQSGYFGAAIKLQPGYTAGVITSFYLSNNEDYPGNHDEIDIEFLGTTPGEPYTLQTNVFIRGSGDRNIVGREVKFHLWFDPTQDFHNYAILWTPSEIVFFVDDVPIRRYPRKSDATFPLRTMWVYGSIWDASSWATDDGKYKADYQYQPFVGRYKNFKIAACRADGQASCRPPSVSPSGFGVLSPQQESAMEWAQRNSLVYNYCLDPKRDHTPTPEC

SEQ ID NO: 12315 - protein, 468 aa, Kjellmaniella crassifolia
IPYAKMGYWDADYNVKDTDILALFRITPQPGVDPVEAAAAVAGESSTATWTVVWTDLLTACDIYRAKAYRVDPVPGTSDQYFAYVAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMVDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAATTCSPLKAALDLWKDITFDYTSTDTPDFVEVGTESK

SEQ ID NO: 12316 - protein, 344 aa, Oryza sativa
  unsure (1)..(344): unsure at all Xaa locations
MRPSLMRSASQVLRRRRGYSSASGQPERKVAILGAAGGIGQPLSLLMKLNPLVSSLSLYDIAGTPGVAADVSHINAPGTPGAGEGGHGGXTRLGESRASVSDEQLGEALEGSEAGIIPAGLXRKTGTTRDDLFNINAGIVKGSCTAVXKYWPYTLLNMISNPVNSAAPIAAEVVWWAGTYDEKNTVLYAARLMLSRADTFYAGXAGLAGITILLLFSQATPATNALSDEDIKALTKRTQDGGTEVVEAKAGKGSATLSMAYAGAVFANACLKGLNGVPDVVECSFVQSTVTELPFFASKVKLGKNGVEEVLGLGQLSDFEKEGLENLKGELKASIEKGIKFANA

SEQ ID NO: 12317 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 12318 - protein, 403 aa, Oryza sativa
MAISSLHATTSLHSPCTTNTSFRQNQVIFFTTRSNRRGSTRYGGARTFQVSCSVDKPVVIGLAADSGCGKSTFMRRLTSVFGGAAEPPKGGNPDSNTLISDTTTVICLDDYHSLDRTGRKEKGVTALDPRANDFDLMYEQVKAIKEGKAIEKPIYNHVTGLLDPPELIQPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSSITWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIIAERAGAPTEAAKV

SEQ ID NO: 12319 - protein, 427 aa, Pseudomonas syringae pv. tomato str. DC3000 [sequence omitted]

SEQ ID NO: 12320 - protein, 251 aa, Leptospira interrogans serovar lai str. 56601
MSSMKNVIITGASSGIGKELARLYAQTGANVALTARRKDVLKKIVEELKSSGTKGKILFASLDVSDADQNFKVIPKLIKELGGLDLIVLNAGISTTSSFGGRSFEADRAVIETNLIGAMAGVEAVLPVFQKQKSGQIVAISSVASFRGLPGSASYSSSKAGLSVYMEALRGEVKRYGISVSVIHPGFIDTPINNRMKSRPFVISVERGAQKIFKRIENNVLSATVPWFPWVFLGYLMKRIPEFLWSKISLK

SEQ ID NO: 12321 - protein, 488 aa, Zea mays
  unsure (1)..(488): unsure at all Xaa locations
MMAASGAYAAQLPAVPEWLNKGDNAWQLTAATLVGIQSMPGLVVLYGSIVKKKWAVNSAFMALYAYASSLLVWVLAGFRMAFGERLLPFWGKAGVALSQGYLVRRASLSATAHGATPRTEPLYPEATLVLFQFEFAAITLVLLAGSVLGRMNIKXAWMAFTPLWLLFSYTVGAFSIWGGGFLYHWGVIDYSGGYVIHLSSGIAGFTAAYWVGPRLKSDRERFSPNNILLMIAGGGLLWMGWAGFNGGAPYAANIAASVAVLNTNVSAATSLLTWTCLDVIFFGKPSVIGAVQGMMTGLVCITPGAGLVQTWAAVIMGVFAGSVPWFTMMILHKKVALLTRVDDTLGVFHTHAVAGLVGGVLTGLLATPELLEIESPVPGLRGAFYGGGIRQLGKQLAGAAFVVAWNVVATSLILLAIGLLVPLRMPEDQLMIGDDAAHGEEAYALWGDGEKFDATRHDAVRVAGGMDREGSAEQRLSGMGARGVTIQL

SEQ ID NO: 12322 - protein, 360 aa, Zea mays
  unsure (1)..(360): unsure at all Xaa locations
PIRSPTSPHPPGCGGGPLLTSPGVGKIKIGVNGFGRIGRLVARVALQSEDVELVAVNDPFITTGGGADMFKYDTGHGQWKHSDIALKDSKTLLFGEKPGTGFGIRNPEEIPWGEAGAEYVXESTGGFTDKDKAAAHLKGGAKKGGISAPSKDAPMGGGGVNEDKYTSDGNIGSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 12323 - protein, 331 aa, Glycine max
MGYVSVKVVVISTGVLSMAMGLKLTLPLLSHFLLNQAPHLWTLLLTCFTPPYLYIFLNFIILTIVASSKLNNHHHSPPDTTLLPAIYDGPPASVQIPAPAAAVQSDYNAVSSDKYLYETKPTLSYDSVAGGNGSAGYVYDENTPVKAAVNNNDDDDDEAVGVGVLSPSLQRKDSSDFAFADENEKPLVSARFSHRKSVRSSPEGGKVVALGVAKAKKQETLESTWRTIREGRAMPLTRHLKKAETWETTQQGTPLRDLNGGGGPVMKKSETFAGREKNASARLLRKEPSLSQDELNRRVEAFINKFNADMRLQRQESLRQYKEMMMNRGAH

SEQ ID NO: 12324 - protein, 314 aa, Pyrus pyrifolia
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRFEAMKAKESTPVATT

SEQ ID NO: 12325 - protein, 833 aa, ASPERGILLUS NIDULANS FGSC A4
MPQLDVDKTIEELRLGEKIDLVSGIDFWHTASVPRLNIPSLRMSDGPNGVRGTRFFNGVPAACFPCATALGATWDTELLHKVGHLMGEEAIAKGAHVILGPTINTQRSPLGGRGFESFAEDGVLAGHLAGYCSKGIQEKGVAACLKHFVCNDQEHERLAVDSIVTDRATREIYLLPFQIAMRICKTATVMTAYNKINGTHVSENKKYITDILRKEWGWDGLVMSDCTSESIIAGLDIEMPGKTRWRGDALAHAVSSNKVHEFVLDERVRNVLNLVNYVEPLGIPENAEEKVLNRPEDQALLRRAAAESIVLLKNEDNILPFNKEKSIAVIGPNAKIAAYCGGGSASLDAYYTITPFEGVSAQSKGEVHFAQGSYSYKDLPLIGHLLKTDDGKTGFKFRVYDEPASSSNRELLHELHLVSSQGFLMDYRHPKIKSYLYYVDMEGYFTPEESGVYDFGVVVVGTGKLLVDDEVVVDNTKNQRLGSAFFGNGTVEEKGSKELMAGQKYKITFQFGTAPTSDIDTRGVVIFGPGGFRFGAARRQTQEELISKAVEVASKADQVVVFAGLTSEWETEGYDRPDMDLPPGSDELISKILEVKPNAAIVIQSGTPVTMPWAPKAKALLQAWFGGNECGNGIADVLYGNVNPSGKLPLTFPVRLQDNPSYLNFRSERGRVLYGEDIYVGYRYYEKAQLPPLFPFGHGLSYTTFTREKLELNTSPEKDKLQDGEPITARVTVTNTGKVAGAETVQLWVVPPPTEVNRPVRELKGFAKVHLEPGESKDVEIVVEKKLATSWWDEKREAWASEKGVYWVQVTGTGEGVLTAEFEVKKTRFWTGL

SEQ ID NO: 12326 - protein, 527 aa, Oryza sativa
  unsure (1)..(527): unsure at all Xaa locations
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYXRNLFQKDIFSKVGWIPPAKTMNALEELYRIARAQALIALCGTIPGYWFTVAFIGIMGRFWIQIMGFAIMTAFMLGLAISYHHXTTPGHHTGFIVMYGFTFFFANLGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 12327 - protein, 180 aa, Haemophilus influenzae Rd
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISEGDNVLIIDDLLATGGTVEATVKLVQRLGGAVKHAAFVINLPELGGEKRLNNLGVDCYTLVNFEGH

SEQ ID NO: 12328 - protein, 159 aa, Frankia sp. FE41
ITKEQYSRDPRNIAKKAEAYLRGTGIADTAYFGPEAEFYIFVDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARIRGKTV

SEQ ID NO: 12329 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDGYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLERCRRMVRLHQKAGTDKLTGVHRKYSSSKFGYIATKYEAAHFLVSDSH

SEQ ID NO: 12330 - protein, 203 aa, Yarrowia lipolytica
MSHSQRTYDLLIKLLLIGDSGVGKSCLLLRFCEDQFTPSFITTIGIDFKIRTIDIGNQRVKLQVWDTAGQERFRTITTAYYRGAMGILLVYDVTDEKSFNNIENWYQNVQSYANEGVELILVGNKCDLDEKRVVSTEQGQALADKFGIPFLEASSKTNINVEECFYSVATRIRDTVAKTKGNESGSGGINIAEGEENSASKCC

SEQ ID NO: 12331 - protein, 90 aa, Vernonia galamensis
REQDRFMPIANVIRIMRKILPPHAKISDDAKETIQECVSEYISFVTGEANDRCQREQRKTITAEDVLWAMSKLGFDDYIEPLTVYLHRYR

SEQ ID NO: 12332 - protein, 385 aa, Aspergillus fumigatus
MISARNFVAPARQCLRTTRVSSGFASHLSQLRGYASAADDRVAKFKGQKGPDGKYTVTLIEGDGIGPEIAQSVKDIFAAAKAPIKWEPVDVTPILKDGKTTIPEEAIKSVQKNYVALKGPLATPVGKGHVSLNLTLRRTFNLFANLRPCRSVAGYKTPYDNVDTVLIRENTEGEYSGIEHVVVDGVVQSIKLITREASERVLRFAFQYARSVNKKKVRVVHKATIMKMSDGLFLNTAREIAKEFPDIEFDAELLDNSCLKIVTDPTPYNDKVLVMPNLYGDILSDMCAGLIGGLGLTPSGNIGDECSIFEAVHGSAPDIAGKGLANPTALLLSSIMMLQHMGLHEHAARIQKATFDTLAEGKTLTGDLGGKAKTHEYAEAICKRL

SEQ ID NO: 12333 - protein, 487 aa, Bacillus subtilis
MKIKAQIGMVMNLDKCIGCHACSVTCKNTWTNRSGAEYMYFNNVETKPGIGYPKQWEDQDKYKGGWTLKKGKLELKSGSKTNRLAGLFYNPNQPSIDDYYEPWNYDYETLTNSPQKKHQPVARPKSSLTGDFMNIEWGPNWEDDLAGGHITGLEDPNVQKMEESIKTEFDDVFIMYLPRICEHCINPACVSSCPSGAMYKREEDGIVLVDQNACRSWRYCVSSCPYKKVYFNWQTNKAEKCTLCFPRLEAGLPTICSETCVGRIRYLGVMLYDADKVEEAASVENEKDLYHSQLDVFLDPNDPEVAKLAKEQGIPAEWIEAAQQSPIYKMIIDWKIALPLHPEYRTLPMVWYIPPLSPIMNLFEGKGSRQTAEDIFPAIDQMRIPIDYLAQLLTAGDTDHIRSTLKKMSVMRQYMRAVQTNKSIDPELISSVGLTEQQIEDMYRLLAIAKYDDRFVIPSSHREEVSDLYAEQGSCGLSFSGGPGSCF

SEQ ID NO: 12334 - protein, 499 aa, Ralstonia metallidurans
MSELKDLEYWRGRARALPIPAHAYIDGQWTSAADGATFDCINPATGEQLARVAACGAADVDRAVAAARRAFEAGVWSAMPRRERKAVLLRLAALIETHREELALLETLDMGKPIGDTMLYDIPEAARTYAWYAEAIDKVYDEIAPTDAGVLATITREPLGVVAAVVPWNYPLLMASWKVAPALAAGNSVVLKPAEQSPLTAIRLAALAEEAGVPPGVFNVVPGLGAEAGQALGRHPDVDCLAFTGSTATGKRFMEYSGQSNLKRVWLECGGKSPHIVFDDCPDLDRAALAAAIGIFNNQGEICIAGSRLYVQRGIYDTFMAKLEAHAAAMQPGDPLDPRSAMGAIVDGRQFDRVMSYVEAGQREGARLRAGGQAARADSGGWFVQPTIFECPTQSLSIVKEEIFGPVLAVTVFDTEAEAVAMANDSAYGLGAGLWTSDLSRAHRVSRRLRSGLVWVNCYMDGDITVPFGGVKQSGFGRDKSLHALEKYQDLKTTWIRLE

SEQ ID NO: 12335 - protein, 403 aa, Zea mays
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 12336 - protein, 336 aa, Triticum aestivum
MGCSLSGLNALYDAATGGGDVWINERRFRVLRQIGEGGFAFVYLVKEHDASSDAARDRHPSHVSDDGTYAMKKVLIQSREQLDLVKEEIRVSSLFNHPNLLPLLDHAIIAVKSTQGDWSHEAYLLFPVHLDGTLFDNAAVMQSRKEFYSVVDVLRIFQQICEGLMHMHRLDLPYALNDVLPGNVLVTCRKGQAPLATLMDFGSSRPARNQIRSRSEALRLQEWAAEHCSAPFRAPELWDCPSHADIDERTDIWSLGCTLYAIMYGVSPFEYALGESGGSLQLAIMNAQLKWPALPSTYPDALHKFVTWMLQPQPEMRPRINDILLHVDKLVEKYSP

SEQ ID NO: 12337 - protein, 127 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 12338 - protein, 492 aa, Burkholderia fungorum
MEKFLVGDEWRSGNGESFESINPIDGSVAATLAQASESDVDDAVRAARQALETPAWRDMKVHERGKLLHRFADLIDQNAETLAQIQTRDNGKTISESRFQSKSAADMFRYFAAVCETTESSVIPSRGNYFCFSSFEPVGVVAAIAPWNSPITLEAQKLAPALAAGNAIVLKSSEVTPCIGLQYGRLAMEAGFPPGILNVVTGFGASVGRALVAHPGVDMVTFTGGTKSGREIAKVAGERLIPCILELGGKSPNIVFDDADIEQAVTGMLFGIFSNAGQSCIAGSRILIQEGIYDAFVARLTSATRALKVGSPYDADTAVAPVSSFHHRDHIEHFVERALSQGAVALCGGSRPSGGILDKGAYVQPTLLEVTDERSSVAHEEIFGPVACVMKFQDEEDLYRIANNTAYGLACGIWTADYKKAFRAARRIKAGTVWVNTYKIAEVNVPFGGFKQSGLGRECGIEGMREYMLEKSTYLNLADGPIPWPPRAANAV

SEQ ID NO: 12339 - protein, 419 aa, Cryptonemia rotunda
ETDVLALFRVTPQPGVDPIEASAAVAGESSTATWTVVWTDLLTACDLYRAKAYKVDAVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERYLYSMEAVNRSIAATGEVKGHYMNVTAATMEQMYERAEFAKQLGTVIIMIDLVIGYSAIQTMGIWARKNDMILHLHRAGNSTYSRQKSHGMNFRVICKWMRMAGVDHIHAGTVVGKLEGDPLMIRGFYNTLLFTHLDVNLPQGIFFEQDWASLRKVTPVASGGIHCGQMHQLVDYLGEDVVLQFGGGTIGHPDGIQAGATANRVALEAIIIARNEGRDYVAEGPQILQDAAKTW

SEQ ID NO: 12340 - protein, 306 aa, Zea mays
MREEQVVAPKPGGGCRRHVGGADGVRSWARRTPVAELLPLLVPSARKRARVPISGWGWPRGPGGLGASARVYVGVNLEFRGLPLCHSVHAEQFLVANAAAAGEPELRAVAVSHMPCGHCRQFLQEIRGAASIRILVTSDAAEGCAPEWRTVASLLLRPFGPNDLLPGDVPLVLEAHDNALGDPVANGLARGDLDARLRQAAEAAARAAHAPYSKCPSGFAVADGDGRIYAGGCLESAAYNPTLGPVQAAIIAMVAAGGGPAVDVVAAALVEKEQASVAQEATARIFLDAVAPHASFHVYNYRPSDA

SEQ ID NO: 12341 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGDGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 12342 - protein, 112 aa, Beta vulgaris subsp. vulgaris
HVIKIKDIILPPEREKFNDVYIVYELMDTDLHQIIRSNQELTEDHCQYFLYQLLRGLKYIHSANVLHRDLKPSNLLLNANCDLKICDFGLARTTAETDFMTEYVVTSWYAPG

SEQ ID NO: 12343 - protein, 522 aa, Triticum aestivum
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 12344 - protein, 369 aa, Triticum aestivum
MFMNCNFNSNLLENEAGRISFPWARPCDGCHAAPSTVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWLLRRNSDDNNCANKIDRYYNLVGYNMYYDNITCDPRPEEQYRMQEQHVQNRYIEKEGCECVVPPQVVMASEQQESDYGTIGAGQAASVTAMTSTYTASISNDISFSSMEVGIVPDNSRPDISNSNILTSSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 12345 - protein, 328 aa, Eremothecium gossypii
MMDKLDLDQLPYYDPRVERKVALVTGGNSGIGWYTVLHLYMHGFIVYVGGRNSSRVHKAIKEIKQEAENRLETARQDPHDELERCLGELRYLPIDLTDLRSVEKAAKKFRAQESTLDVLINNAGVMALPYELTHDGFEVQMQTNYVSHFLLTMRLLPYVKRSGGRVVTLSSIGHKIQFTYCPLDCHFDYRPNIFFTWLRYAMAKTAAIQFTKMLAIKHPDVMCIAVHPGLVMNTNLFSYWTRLPIVGIIFWIFFQIVGFCFGVSNEEGSIGTLKSALSPALTLERDNGKYFTTGGVESRPSSVANNLDNAASTWIWTVHQLRDRGYEI

SEQ ID NO: 12346 - protein, 339 aa, Desulfovibrio desulfuricans G20
MNLTEALLHALKERGAKEVYGIPGDFALPYFKIIESTGILPLVTLSHEPAVGFAADASARFRGGLGVAAVTYGAGALNMVNAIAQAYAEKSPVVVISGAPGTHEGGHGLLLHHQAKHLDSQYRMYKEVTCDQAVLDDPATAPETIARVLQSCIEHSRPVYLEIPRDLPAAPCAPVPAFAASGTDADAVDACARDVLQRVQSAALPMMMVGVEVRRYGIEDKVALLAERLGVPVVTSFMGRGLLASASCLEGTYLGMAGDETLSEAVESSDGLLLLGVIMSDTNFGVSGSQLDRRRVMHAEDRQVRVGYHVYHDIPLGALVDRLLALLDDGQEADMALSG

SEQ ID NO: 12347 - protein, 861 aa, Agaricus bisporus
MPPSDFANADIDKIVDALTTDEAILLSAGVGFWHTHAIERLQIPAVKVSDGPNGIRGNHFFMGTPAKCLPSSTAMGATFDRDLLEEVGLKLLAREAKLRSASVILAPTCNIQRNPLGGRSFESFSEDPFLSGMLCSAYINGIQKGGIGATIKHFVGNDKEDDRTGYDSIHYRTTSSGDLSPSVHAGSRNMPLHGAIMTAYNRVNGIHVCENPELLQKILRDEWKSDVMIMSDWFGTYSVDVGLNAGLDLEMPGLNKWRSLESVNRSIQSRKVTAKKVKERARKVLELVKKCAQGAPEILDGDGLERTLDSDEDNALMRKFAAESIVLLKNDKKVLPLDRKSLKKVAIVGGNAKAAVLSGGGSAALKPSYFVARPAGLVKALKEVNPNIEVTYSEGARAAKTLPTLDFDLFTESGQRGWTGSWHAHENDDSLVALPTPIKTQYVDETRMFISSSSPAGITKKWTLRMKGYLKPRERDCKFEFGLTAAGRAKLFVDGKLVIDNWTRQRRGVEFFGCGSEEETGVVELKAGVKHEIYVDFCNVRGPADGDETETIMDSNPGIRLGGAEVEDPDELLNSAVSIAKDADAVIIVVGLNGDWETEGNDRTTLALPGRTDELVQKVVAANPRAVVVTQAGSAITMPWVDQVSSLLHTWYLGNATGDAIADVIFGNHNPSGKLSLTFPKRLEDVPAHGYFHSEKGKVTYAEGLYVGYKHYQHRNIEPLFAFGHGLSYTSFNISDLRLSQPIVSGDQFDLKATVKLTNTGNITGSQVVQLYIGLPKTSELTHPRWQLRGFKKMRDVKPGESREVELVMDRLSVSYWDKEWVVENGAYDVRVAFTSEEGVGEGQELLGRFNVEKGFGWRGL

SEQ ID NO: 12348 - protein, 180 aa, Lactobacillus fructivorans
NSVVYDPTIADSIENYSRLYVNPQNAAFLSIDHDDPETIRESLKNTAAGRNIKLIVVTDGEGILGIGDWGTQGIDIPVGKLMVYSAAAGIDPSEVLPVVMDVGTTNKSLLDNPLYLGNHQDRDYGQKYYDFVDKFVKEAEDLFPNLYLHFEDFGRRNASNILDKYKDDYLVFNDDIQGTG

SEQ ID NO: 12349 - protein, 268 aa, Oryza sativa
  unsure (1)..(268): unsure at all Xaa locations
MGMARARARRLLPLLTFVTLGMILGSLLQLAFFRRIDDHSNVTHLENDQEAAFLRLGLVKPEVISWSPRIIVFHNFLSSEECDYLRSIARPRLQISTVVDVATGKGVKSNVRTSSGMFVSSEERKLPVIQSIEKRISVYSQIPEENGELIQVLRYEPSQYYRPHHDYFSDTFNIKRGGQRVATMLMYLTDGVEGGXETHFPQAGDGECSCGGKMVKGLCVKPNKGDAVLFWSMGLDGETDSNSIHGGCPVLEGEKWSATKWMRQKEFV

SEQ ID NO: 12350 - protein, 471 aa, Zea mays
  unsure (1)..(471): unsure at all Xaa locations
MAGTEVEDPPAAALEVPAKRGLLRYNSPLAQVSLLGLICFCCPGMFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLGRRPRPGSTPFALNYRPRGTREGSVSDGTYICFMAFMLVGAALXLLHLPAQQRQQRPLNAPHQGPQQSPATEGAEILKLFANWKMLLALPAAWASNFFYTYXVQQRQQRPLHAPHQGPQSATKLCXGRPHRFQGRPPLRRALPALLQVRTAGCHVPEPYLLDHRRTRQRLPQLQCRAGARXIDFKDGDRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 12351 - protein, 90 aa, Oryza longistaminata
RDAKARYVKFHWKPTCGVSCLMDDEATLVGGKNHSHATQDLYDSIAAGNFPEWKLFVQVIDPEEEERFDFDPLDDTKTWPEEEVPLRPVG

SEQ ID NO: 12352 - protein, 569 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTN

SEQ ID NO: 12353 - protein, 337 aa, Zea mays; identical to SEQ ID NO: 2392

SEQ ID NO: 12354 - protein, 210 aa, Lycopersicon esculentum
AHEMSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 12355 - protein, 172 aa, Triticum aestivum
  unsure (1)..(172): unsure at all Xaa locations
RHGDVLVLDGCAENMNDGKTYAYLSSVPRLFAAEPYDYVMKADDDTYLRVAALAGELRGKPRHDVYLGYGYAMGGQPMPFMHGMGYVVSWDXAAWVAGAREILERNDNLGXEGLKVRKWXNLAGKGQEPLQLKPRMYDSTGTWTTGRVAQLKTNGGRRVKYSHGILVQLTTA

SEQ ID NO: 12356 - protein, 502 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLSSLQCEEDEENSWKC

SEQ ID NO: 12357 - protein, 330 aa, GIBBERELLA ZEAE PH-1
MPCHPTEPEFEVRDIPSLRGYVAIVTGETDYSGNSGIGYETTLQLALKGARVYIASRSNDRVNKAIAEMHKNSPDLDLHFLKLDLQDMQSIKDTTADFMSRENRLDILINNAGIMSSPWELTKDGHEIQWQTCFLSHHALTMSLMPLLVTAAQVSGRMDRVRIINVASDMALRMGPEAIHYDDPNLTNETGKLAPWRRYGHCKEASIIAAKAITDRYQSLGVTAYSLHPGLVKSNLQSHNPTMLGAMSRMMFKVGPSSTPLEGAMNSLFCATSHKVYEHAGRYYVPVQKLDDRANKWLDDAQAVNKLWDLATRQCREHGFIIDDIPGYYN

SEQ ID NO: 12358 - protein, 815 aa, Escherichia coli O157:H7 EDL933
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADLDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 12359 - protein, 488 aa, Scytosiphon canaliculatus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATGSR

SEQ ID NO: 12360 - protein, 352 aa, Staphylococcus aureus subsp. aureus Mu50
MKEQLNQLSAYQPGLSPRALKEKYGIEGDLYKLASNENLYGPSPKVKEAISAHLDELYYYPETGSPTLKAAISKHLNVDQSRILFGAGLDEVILMISRAVLTPGDTIVTSEATFGQYYHNAIVESANVIQVPLKDGGFDLEGILKEVNEDTSLVWLCNPNNPTGTYFNHESLDSFLSQVPPHVPVIIDEAYFEFVTAEDYPDTLALQQKYDNAFLLRTFSKAYGLAGLRVGYVVASEHAIEKWNIIRPPFNVTRISEYAAVAALEDQQYLKEVTHKNSVERERFYQLPQSEYFLPSQTNFIFVKTKRVNELYEALLNVGCITRPFPTGVRITIGFKEQNDKMLEVLSNFKYE

SEQ ID NO: 12361 - protein, 293 aa, Escherichia coli K12
MKGIILAGGSGTRLHPITRGVSKQLLPIYDKPMIYYPLSVLMLAGIREILIITTPEDKGYFQRLLGDGSEFGIQLEYAEQPSPDGLAQAFIIGETFLNGEPSCLVLGDNIFFGQGFSPKLRHVAARTEGATVFGYQVMDPERFGVVEFDDNFRAISLEEKPKQPKSNWAVTGLYFYDSKVVEYAKQVKPSERGELEITSINQMYLEAGNLTVELLGRGFAWLDTGTHDSLIEASTFVQTVEKRQGFKIACLEEIAWRNGWLDDEGVKRAASSLAKTGYGQYLLELLRARPRQY

SEQ ID NO: 12362 - protein, 86 aa, Glycine max
  unsure (1)..(86): unsure at all Xaa locations
GKYERVGTTQKRARAGKVAPFTGLKYMAVVPTRKTNQELTFIDRNGGGVLCLQVWPRAGKXMRVTLFYVPDIDDAHVGDEVQYLLM

SEQ ID NO: 12363 - protein, 306 aa, Bifidobacterium longum DJO10A
EGMIPSADALFCDARDDDGTIKRKARHMAEATANIGVIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFVLL

SEQ ID NO: 12364 - protein, 352 aa, Hordeum vulgare
MANEEALMFALQLASSVVLPMTLRTCIELGLLETLVGAGGKTLTPEEVAAKLPSKAESNPDAASMVDRLLRVLATYKVVSRLVDECADGSLSRRYGAEPVCKWLTPNEDGVSMAPFCLLAQNKLFMEAWCHMKDAVLEGGSAFTKAFRASWFDYAGTDDHFNHLFNEAMKDHSVIITKKPLELYTGFDGIDTLVDLAGGVGAVIHAITKKYPSIKGINFDLPHVISDAQPYPGVEHVGGDMFEMVPSGDAIPMKWILPCFSDDECAVLLKNCYDALPAHGKVINVECILPVNPDATNNAQGLICVDASLLAYSPGGKERNLRDFEKLAKAAGFTGVKASYIFANFWAMEYTK

SEQ ID NO: 12365 - protein, 191 aa, Serratia marcescens
MLLLIDNYDSFTYNLYQYFCELGAEVVVKRNDELQLTDIERLAPQHLVISPGPCTPNEAGISVAAIRHFAGKLPILGVCLGHQALGQAFGAEVVRARAVMHGKTSAIRHLGVGVFRGLSDPLTVTRYHSLVLKADTLPDCFEVTAWSERDGVRDEIMGIRHRALALEGVQFHPESVLSEQGHQLLDNFLNR

SEQ ID NO: 12366 - protein, 524 aa, Bradyrhizobium japonicum USDA 110
MISAITHTARLMRAAFVFAREGVFGSVDPSLVPPPGQLALKLARIVERRGPKHGPRLSRALTRMGPAYLKLGQFLATRPDVVGVIMARDLESLQDRLPPFSQAEAEAAIAASLERPLKDVFASLGPPVAAASIAQVHRGEVVRDGIRKAVAVKVLRPNVASRFRRDLSDFFYVAHKAETYSAEARRLRLIEVINTMSRSVAMEMDLRLEAAAMSEMAENTGDDLDFRVPTVDWDRTTHNVLTMEWIDGIALNDHKRLAEAQVDLPDLGRKVIQSFLRHALRDGFFHADMHPGNLFLDDTGRLVAVDFGIMGRLGMKERRFLAEILLGFITRDYRRVAEVHFEAGYVPAHHSVENFAQAIRAIGEPIHNRTAEEISMARLLTLLLEVTGLFDMTTRPELILLQKTMVVVEGVARGFDPRLDIWKTADPVVREWIERNLGPIGRVQGALTGGGDLARVLMRLPDIAQRSVAVLEQLETMTREGLRLSPESIAAMGRSEGRKNRWRTVALWIIAATFIGILIAVRNL

SEQ ID NO: 12367 - protein, 324 aa, Pseudomonas aeruginosa PAO1
MSTLSTDQLLHAYRVMRTIRAFEERLHVEFATGEIPGFVHLYAGEEASAAGVMAHLRDDDCIASTHRGHGHCIAKGVDVHGMMAEIYGKKTGVCQGKGGSMHIADLEKGMLGANGIVGAGAPLAAGAALAAKLKGSDAVAVAFFGDGGSNEGAVFEAMNLASVWNLPCLFVAENNGYAEATAANWSVACDHIADRAAGFGMPGVTVDGFDFFAVHEAAGAAIERARAGEGPSLIEVKLTRYYGHFEGDAQTYRDPDEVKHYRETRDCLKQFRERTCHAGLLSASDLDAIDAEVEARIEDAVQRAKNDPKPEPDDLLRDVYVSYP

SEQ ID NO: 12368 - protein, 384 aa, Saccharomyces cerevisiae
MVFDLKRIVRPKIYNLEPYRCARDDFTEGILLDANENAHGPTPVELSKTNLHRYPDPHQLEFKTAMTKYRNKTSSYANDPEVKPLTADNLCLGVGSDESIDAIIRACCVREEKILVLPPTYSMSSVCANINDIEVVQCPLIVSDGSFQMDTEAVLTILKNDSLIKLMFVTSPGNPTGAKIKTSLIEKVLQNWDNGLVVVDEAYVDFCGGSTAPLVTKYPNLVTLQTLSKSFGLAGIRLGMTYATAELARILNAMKAPYNISSLASEYALKAVQDSNLKKMEATSKIINEEKMLLLKELTALDYVDDQYVGGLDANFLLIRINGGDNVLAKKLYYQLATQSGVVVRFRGNELGCSGCLRITVGTHEENTHLIKYFKETLYKLANE

SEQ ID NO: 12369 - protein, 358 aa, Penicillium marneffei
MGGCVSSESNVDLEQKKRSQMIDRKIEEDSRRLRRECKILLLGSGESGKSTIVKQMKIIHQNGYSVEELTMYRLTVYKNLLDCAKSVIEAYEHFDIEPTSQKVRDFITYISEYNIDPDPSIPLDPKVGDAVTFIWNDPCTASVMEHQSEFYLMDSAPYFFENAKRIAASDYIPNEADVLRARTKTTGIYETRFTMGQLSIHMFDVGGQRSERKKWIHCFENVTSIIFCVALSEYDQVLLEESNQNRMMESLVLFDSVVNSRWFMRTSIILFMNKVDLFRQKLGRSPLSNYFPDYSGGNDVNRAAKYLLWRFNQVNRAHLNLYPHLTQATDTTNIRLVFAAVKETILQNALKDSGILSY

SEQ ID NO: 12370 - protein, 80 aa, Glycine max
  unsure (1)..(80): unsure at all Xaa locations
IFALSFSVLSVLTGITNSXTLYNTGLNYGGPVSMQYGWFMALAFTMLVALSMAEICSSXPTTGGLYYWSAKLAGPRWAPF

SEQ ID NO: 12371 - protein, 483 aa, Oryza sativa
MNVLASKIFPSRSNVVSEQQQSKREKATIDDAKNSSKNKNLDRSVDESVLGIILGGGAGTRLYPLTKKRAKPAVPLGANYRLIDIPVSNCLNSNISKIYVLTQFNSASPNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 12372 - protein, 178 aa, Oenococcus oeni
PIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGI

SEQ ID NO: 12373 - protein, 374 aa, Zea mays; identical to SEQ ID NO: 2309

SEQ ID NO: 12374 - protein, 489 aa, Phytophthora infestans
MADLSDIGLFGLAVMGQNFALNMASHGFKVSVCNRSPDKVDATVQRAKDEGNLPLVGFKDMKEFVASLARPRKVVILVVAGKPVDLTIAALSEFMEPGDIIVDGGNEWFPNSVRRASELEPKGIHFVGMGVSGGEEGARNGPSLMPGGPKEAFDALEPIITKCAAQVDDGACTTYLGPIGSGNYVKMVHNGIEYGDMQLIAEAYDILKIAGGLTNDELASVFDEWNKGELESFLIEITAQIFAKKDDLTDDGYVVDKILDKTGMKGTGRWTVQEAAERSIAAPTITASLDARYLSARKDERVFASKILSGPSEIPAVDKQQLIDDVRQALYASKICSYAQGLNLIREAGVQMGWNVDLGECARIWKGGCIIRAKFLDRIKSAYTKDASLISLLVDPDFAAELQARQYSWRRVVSLAVASGIPAPSFSGSLNYYDTFRRERLPANLTQAQRDFFGGHTYERTDREGLYHCAWSAAHHSIGDVSERIRGNL

SEQ ID NO: 12375 - protein, 552 aa, Edwardsiella tarda
MAGMVIYPIVNIDFLQFLEKTQLNKPSQHATTTEESAMNIVNGINGLIAKKNVLFFLTSLAISPSVLADTLTRDNGAPVGDNQNSQTAGPNGPVMLQDVQLLQKLQRFDRERVPERVVHARGTGAHGVFTPTADISDLTVAKVFTPGSTTPVFVRFSSVVHGTHSPETLRDPRGFATKFYTAEGNWDLVGNNFPTFFIRDAIKFPDMVHAFKPDPRTNLDNDARRFDFFSHLPESTRTLTLLYSNEGTPLSYRNMDGNSVHAYKLINDKGESPLCEVHWKTRQGIKNLDPQQVEQIQGKDYSHMTQDLVTAINRGDYPKWDLYIQVLRPADLKNFDFDPLDATKAWPDVPERKIGEMVLNKNPDNVFQETEQVAMAPSNLIPGIEPSEDKLLQGRLFAYADTQFYRIGANGLSLPINKPHSVVNNGNQDGQLNSGHTLDKGVNYQPSRIYPREELVSSRYSQTPLSGTTQQSKIQREQNFKQAGELYRSYSKKEQNDLINSLGTSLASADTVSKNIMLSYFYKADKDYGTRLTSVANGDLPTVKNLADKLQD

SEQ ID NO: 12376 - protein, 1226 aa, Oryza sativa
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKGSLSNSIQAPFRAYRHLNPQCAYDPCETPKESESPRFKAIMQATSAPRKRVPADIKSFSHELNSKGVRPFPFWKPRGIYNLKNLVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVPKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMFLVSSSPTKQIHIL

SEQ ID NO: 12377 - protein, 493 aa, Saccharomyces cerevisiae
MTVFSGVNKIEFEGTFEGIGKDVVMSQMIRALQKHFPSIRDKNYEFSLFLHIFQRYVLENTSITHDLVCDKIRLPIIDEVVELDDIKNYGLLEGKLLSKLAILKLTGKANPIIGKESPLFEVKNGMSSLDVIVRQTQNLNVRYNSDVPLIFMTSLETESQVSNFLEEHYSSSKVRWKTVVQSSFPQIDKDRLLPIDLQINSHENDFWYPCGTGNLTDTLYFSGELDKLIAQGKEILFVSNVDNLGATGDLNILNFIINEKIEYLVEVVERTANVSNTGVLATYKGKLRSVYYNCLSNESASTCRIVNTNNIWIDLKKLKVLIESNSLNLPIHSSESKITHKNEEIECLQFKTQLVDCIAFFPNSRVLKVSRDRFLPLRTCKDLFLLKSTLYDLDSNGTFNLYPLKFGLLPSIDLGDEFATYETFKIGVPDIPNILELEHLTVMGNVFFGRNITLKGTVIIICDENDVITVPDGSILENVTIWHKSQLEDMNGY

SEQ ID NO: 12378 - protein, 256 aa, Wigglesworthia glossinidia endosymbiont of Glossina brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 12379 - protein, 414 aa, Heliobacillus mobilis
MDFFQCIPLQSAKEVITQNLTGAVVPPETVFLLDALGRVAAEDIVAQENLPPFSRSTVDGFALRSADTFGSSESAPSLFSIVGEVSMGEPATIELLPGQAVAIPTGGMLPAGSDAVIMLEQTIQPDAQTLLAVKMVAPGENVVSAGEDVRSGAVLLKEGQRIAPQHIGVLAACGFARVPVRKRVKVSVISTGDELVDIQDIPMAGQIRDVNSYALAAMLTEFGCDVTPMGIVKDSYEQFFTALGQAVATSQLVIISGGSSVGARDYTVKAIDALGAPGVLFHGISIKPGKPTIFGMIGQVPVFGLPGHPVAAMTVCEQLVKLALGNLFGQREASGTVRLTAQLTRNVASAPGRDDFINVRLRRQQGTYKAIPILGKSGLIHLLAQSDGIMHVPADKSGLYDGDPVEVLLIKDTE

SEQ ID NO: 12380 - protein, 170 aa, Zea mays; identical to SEQ ID NO: 2818

SEQ ID NO: 12381 - protein, 463 aa, GIBBERELLA ZEAE PH-1
MKSPIPDYLNQVLENARPIEGGKPASYIETLAKADTSKVAVALAMVDGEIYSAGDDDVEFSIQSISKAFVYALAIEDAGLDKVLEKIGVEPSGDAFNSLSLERGSNRPMNPMINAGAITAHSLIGKPDWTMEQRTERILNALSLLAGRQLHVCEEVYEAELRGADRNMGIGYMLKAAGIITGDAQQIVTGYIRQCAINVNVRDLATMAATLCNAGIHPISGDRIIPQDSVRQILSVMSTCGMYDAAGDWLSRIGIPAKSGVAGGIIGALPGQMGIAVFSPKLDHRGNSVRGVAICEQLSSDMGLHMMDVSQIAQATVRTSVATIVAGDNEPNHSNCNKEILIFSLRGVVRFAGSERLTREITRVLGAPNPDDPGCGSSRHACAIVFSFRDVFSFNAVAQRIIQADITRLLLDGRTIVVIDPSGVLTIDTARAGAKLKVVKSETDARDFIGGIGCHTVSKSDEW

SEQ ID NO: 12382 - protein, 316 aa, Saccharomyces cerevisiae
MSITTTRRRNQDSVCCKATRASIKVEAVSGQTVFEKQKLLHNFDELPEWQKDNDKILTGYVRETLSWKKCLYSLFYWNNETVNIYTHLVPAIVYFVFAITLTNYFLIPVFPSTSWSDYTVINIFLMGAFSCLMCSSCFHCMKQHSEKQSNFWSKLDYLGIISLISCSMIPIIYFGYFDHISYFSLFTIVTLVLATFCTVCVLHDKFNTSTFRPFRAMFFILFGFSGLLPLTTGFFKFGIQGVLNRIKVSFVFWEALFYISGAVIYGFRIPETLAPGKFDFFGSSHQIFHIMVVLGSVCHLKAIIDSYKLMHSHIHP

SEQ ID NO: 12383 - protein, 347 aa, Oryza sativa
MPGPTRQRDTSPACPCAAPAAPSGEKSEDVELVAVNDPFITTDYMTYMFKYDTVHGQWKHSDIKIKDSKTLLLGEKPVTVFGISLDESNLFMVASVELMFDPVQFERNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRGPPSCRRLPRATTSIDIPSCVRRKKIVVL

SEQ ID NO: 12384 - protein, 432 aa, Glycine max
MSFTATKFAPSPLPLNSTTPRSNDKPLSFSFDHSKPNPSSSFLGSTRKLLRFNALARPHAHPRASSSPAAAVLLERTSNLLVTKEEGLELYEDMILGRFFEDKCAEMYYRGKMFGFVHLYNGQEAVSTGFIKLLKKEDSVVSTYRDHVHALSKGVPSRQVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGPAFGMPGVHVDGMDVLKVREVAKEAVERARRGDGPTLVECETYRFRGHSLADPDELRDPAEKEHYAGRDPITALKQYLIENNLANEQELKAIEKKIDEILEDAVEFADSSPLPPRSQLLENVFADPKGFGIGPDGRYRCEDPKFTEGTAHV

SEQ ID NO: 12385 - protein, 566 aa, Oryza sativa
MGLQGNKATHDFLSLYAAAATATDYSPLPRHPDSKPSAPAPPPAQDFFLKTHDFLPQVEKRADQTPPPPPPPPPHAAVTAEKQLLHQHALAAAGAFTINHAVAAAATAVKQEPPFAPWCQPVAAVDPRGHQWSLPFAARAVAVASSRPQQQQQQPPPPERKGGGGFMDAGSRSSGGAGFDDDDGHAARREVSSSLKELTVRVEGKGGSCSGSAGTDQMPNTPRSKHSATEQRRRSKINDRFQLLRDLLPHNDQKRDKASFLLEVIEYIRFLQEKVQKYEVSYPEWNQENAKVVPWTNIYFRSSWKNAQNKGQVPADHSPDPPELLKNGSPYMFPFTGNSDNNNAVETAAASGAQDQAETDPMSRVSYRSVDTPSPNNVADKVTSQPHAQLVRPSPAENHTVNCDKLNNSDLAIDEGTISLSSQYSQELLNKLNHALENSGIDLSQASISVQINLGKRAMKRSTPAATSTSKVGFMSRIDTKSHYIMFVVIEIGAGNGCYTWSSLIRHLIVKQWAVSLGWVMALKNIDKPQSDTNQITADGLLLKTPDIQPFFAPNCVRGAPRFYVY

SEQ ID NO: 12386 - protein, 499 aa, GIBBERELLA ZEAE PH-1
MANPFQRPFQLENESLFHCTSLINGDFVSAKEGKTFNVVDPGSGKTWASCPDCTASDVDSAVASSYETFKTYSKTTPRFRAQTLMKWHNLILAAREDLARILVHETGKTLVEARGEIDYALTFVWWFSGEADRAHGTSMSCAIPGRRAVTIKQPIGVAAALVPWNFPIALALRKAAAALAAGCTMVVKPSPETPLTCVSIAHLALEAGFPRGALNVVTTSLENTPTVAEALCLDARVKKVSFTGSTRVGKIIASFCAPNLKKTTFELGGNCPFIVFDDADVGQAVSQLMPLKWRHAGQACITSNRVFVHSSIYDTFVEKVVQETRGLKLGHGMEEGSTMGALTTPRGLDKAEELYQDAISKGAKTVLGTGKREEGQGYFMAPTILTEMEDDMLMTHEEIFAPVLGFYRFESEEEVVQRANDTPLGLASYIFTKNVDRLWRLFENLDAGMIGLNAGNSSSAEAPFGGIKDSGHGKESGKDVAIDEFLITKTATLTIDGHY

SEQ ID NO: 12387 - protein, 356 aa, Kluyveromyces lactis
MPDMTNESSSKPAQINIGINGFGRIGRLVLRAALTHPEVKVRLINNPSTTPEYAAYLFKYDSTHGKYRGEVEFDDERIIIQNDHVSAHIPLSHFREPERIPWASYNVDYVIDSTGVFKEVDTASRHKGVKKVIITAPSKTAPMYVYGVNHVKYNPLTDHVVSNASCTTNCLAPLVKALDDEFGIEEALMTTIHATTASQKTVDGTSSGGKDWRGGRSCQGNIIPSSTGAAKAVGKILPELNGKITGMSIRVPTINISLVDLTFRTAKKTSYDDIMKALEQRSRSDMKGVLGVTKDAVVSSDFTSDSRSSIVDAKAGIELNDHFFKVLSWYDNEYGYSSRVVDLSIFMAQKDFEAGV

SEQ ID NO: 12388 - protein, 297 aa, Arabidopsis thaliana
MSRLGLLLFVAILLVLLQSSTCLISSPSSIINPSKVKQVSSKPRAFVYEGFLTDLECDHLISLAKENLQRSAVADNDNGESQVSDVRTSSGTFISKGKDPIVSGIEDKLSTWTFLPKENGEDLQVLRYEHGQKYDAHFDYFHDKVNIARGGHRIATVLLYLSNVTKGGETVFPDAQEFSRRSLSENKDDLSDCAKKGIAVKPKKGNALLFFNLQQDAIPDPFSLHGGCPVIEGEKWSATKWIHVDSFDKILTHDGNCTDVNESCERWAVLGECGKNPEYMVGTPEIPGNCRRSCKAC

SEQ ID NO: 12389 - protein, 181 aa, Saccharomyces cerevisiae
MSISESYAKEIKTAFRQFTDFPIEGEQFEDFLPIIGNPTLFQKLVHTFKTHLEEKFGKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 12390 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 12391 - protein, 384 aa, Burkholderia fungorum
MQSAMQARSKLPDVGTTIFTVIGQLAAQYDALNLSQGAPNFAPDASLIDGVAQAMRAGHNQYAPMAGIAALREALADKVATLYGVHYDPASEVTVIASASEGLYSTISALVHPGDEVIYFEPSFDSYGPIVRLQGATPVAIKLSLNDFRVDWDEVAAAITPKTRMIIINTPHNPTATVFSEADVARLKAITRNTDIVILADEVYEHVVFDGAKHQSMACHAELAERSVIVSSFGKSYHVTGWRVGYCLAPAALMDEIRKVHQFMVFSADTPMQYAFVDALARRESYLGLSAFYQKKRDLLTDALRDSRFELLPSEGSFFMLARFRGFSEESDSDFVLRLIRDARVATIPLSAFYTDGTDSGLIRLSFSKDDATLIEGARRLCQI

SEQ ID NO: 12392 - protein, 396 aa, Bacteroides thetaiotaomicron VPI-5482
MNKITMQKDGTLSVPDVPVVPYITGDGVGAEVTPSMQSVVNAAVQKAYGGKRRIEWKEVLAGERAFNETGSWLPDETMKAFQEYLIGIKGPLTTPVGGGIRSLNVALRQTLDLYVCLRPVRWYQGVHSPVKAPEKVNMCVFRENTEDIYAGIEWEAGTPEAEKFYQFLKNEMGVTKVRFPETSSFGVKPVSREGTERLVRAACQYALDHHLPSVTLVHKGNIMKFTEGGFKKWGYELAQREFGDALADGRLVIKDCIADAFLQNTLLIPEEYSVIATLNLNGDYVSDQLAAMVGGIGIAPGANINYKTGHAIFEATHGTAPNIAGKDVVNPCSIILSAVMMLEYLGWKEAAALIEKALEQSFLDARATHDLARFMPGGTSLSTTAFTREIVERIEK

SEQ ID NO: 12393 - protein, 251 aa, Bacillus megaterium
MRKPIIAGNWKMNKVLSEATSFVEEVKGAVPSPESVDSVVCAPALFLDRLVEATKGTDLKIGAQNMHFEENGAFTGEVSPVALADLGVNYVILGHSERREMFAETDETVNQKTIAAFKHGLTPIVCCGETNEEYEQDQTKTVVANQVQKALAGLTDEQVKQTVIAYEPIWAIGTGKSSTAEGANEVCAYIRSVVAEQFSQDVADAVRIQYGGSVKPANIKEYMSQSDIDGALVGGASLEADSFLQLLEAGK

SEQ ID NO: 12394 - protein, 227 aa, Picea mariana
AILIDWLIEVHLKFELMPETLYLTVNIIDRYLSIEIVTRKNLQLVGITAMLLACKYEEIWAPEINDFVCISAKEYASEQLVAMEHTILNQLKFNLTVPTPYVFLVRFLKAAGSDKEMENLAFFLVDLSLLHYIMIKYSPSMLAAAAVYTAQCTLKKSSPWSKTLILHTGYSEADLKECAHFMVNFHLNAGGSKLRVVHKKYSDPFFGCVAFLSPANLPVDDSCSSSN

SEQ ID NO: 12395 - protein, 175 aa, Glycine max
MSAYKDQDPRLHGIKTKIRVVPNFPKSGLMFLDITTLLLDPKAFKDSIDLFVERYKGKNISVVAGIEARGFIFGPPIALAIGAKFVPLRKPKKLPGKVISQEYILEYGRDCLEMHVGAVDDLIATGGTLCAAMDLLERVGAEVVECACVIELPELKGRERLNGKPLCVLVEYVDI

SEQ ID NO: 12396 - protein, 180 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 12397 - protein, 477 aa, Solanum tuberosum
MATAATLSPADAEKLNNLKSAVAGLNQISDNEKSGFINLVGRYLSGEAQHIDWSKIQTPTDEVVVPYDKLAPLSEDPAETKNLLDKLVVLKLNGGLGTTMGCTGPKSVIEVRNGLTFLDLIVKQIEAFNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAVKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLEGKVTIAAKSGVKLEIPDGAVIANKDINGPEDI

SEQ ID NO: 12398 - protein, 585 aa, Schizosaccharomyces pombe
MNAYVRDSESVYSESYPPENFISNEPEKSKDKDNFNGEEVISYVGEVETVPAKEENVFRRFINGFKIEKNQQDSAGQGLKRRLKSRHIQMIGIGGAIGTGVWVGSSKSLYRGGAASVLIDYCIVGTMVFCTVYALGELAVAFPTRGSFVTHATRFIDESWGFALSWNYVFSFIVTIPLELTTGTMMIKYWTNLNSGIWVTVFIVFLFFINIFGVKGYGEMEFIMSTIKVVAMCGFIILGIIIDCGGVPTDHRGYMGTHIFRENAFRHKFKGFCAVFTSAAFSFSGTEYVGVAAAETENPAKAFPVAVRQTLFRIAIFYILSLFIVSLLISGADPRLTSYHGVDASPFVLAIKDANIKALPSILNAIILISVISSANAQLYAGSRAIHSLGCNGFAPKCFTLVDREGRPLVALLILFLFMFLGYLVETGQYDTVFDWMLSISGLGTLFCWGSICLAHIRYRAAMKHQNRSLKEVGFVSPFNVYASYYAFILVCLVLAAEFYVSIFPVGGKPDASAFFENYLSAPVILVFFICHKLYYKTKRITLSNMDLETDFAYKTPVEEEEEEEKSAGSLSIKQRMKKLSDMMC

SEQ ID NO: 12399 - protein, 341 aa, Rhodospirillum rubrum
MVFRASPCAPFPLANSAVVLLVDRSQAMDLGYLKSKESGFIAGMILCTAFMGSSFPSGKYLISEEAMPAFYAGGWRFLLAGGLILAFCAAKDGLGAILPASGGSVIKGALFVLVVGCLQTAGTMGFLNLALTTLSASMASLLLFTNPLWVAILAHFALGETLSWHKVVALVCGILGVSLCLGGGADHGLGGIVIALAGSLCWALCTLISKKHKFDKSVFVFTGWQLTLGALVMLAISKLSGEAYDIDRITGWGIACFIWLVGPASIGSFGLWFTALSRRGATVTSSYLFLVPLFSAVFSMMVLGEAVSPHSLIGGAIIIVALWLINLPQTVSAVWRERLGL

SEQ ID NO: 12400 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 12401 - protein, 404 aa, Triticum aestivum
MAFCSPHTTTSLRSPCTTIPNSGFRQNQVIFFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 12402 - protein, 300 aa, Escherichia coli K12
MTMIRVACVGITVMDRIYYVEGLPTESGKYVARNYTEVGGGPAATAAVAAARLGAQVDFIGRVGDDDTGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 12403 - protein, 69 aa, Glycine max
  unsure (1)..(69): unsure at all Xaa locations
RANVKYTETEIXCGYNYENTKHVYENRNGTYQRYGXPKVRNYQFKTNTHGLKMGGMLAGWGGNQLLYPH

SEQ ID NO: 12404 - protein, 328 aa, Neurospora crassa
MENYQKLEKIGEGTYGVVYKARDLANSGRIVALKKIRLEAEDEGVPSTAIREISLLKEMRDPNIVRLLNIVHADGGQGHKLYLVFEFLDLDLKKYMEALPVSDGGRGKALPEGTGAGLHNLGLGEDIIKKFMSQLCEGVRYCHSHRVLHRDLKPQNLLIDRDGNLKLADFGLARAFGVPLRTYTHEVVTLWYRAPEILLGGRQYSTGVDMWSVGCIFAEMCTRKPLFPGDSEIDEIFKIFRLLGTPTEDIWPGVTSYPDFKASFPKWVRDYNVPLCQNLDDVGLELLESMLVYDPAGRISAKAACNHPYFEDYNPKPKSKYRDSSRYA

SEQ ID NO: 12405 - protein, 313 aa, Streptococcus gordonii
MVITKSASRRDLLMSKVKKAVIPAAGLGTRFLPATKALAKEMLPIVDKPTIQFIVEEALKSGIEDILVVTGKSKRSIEDHFDSNFELEYNLKEKGKDDLLKLVDETTGIGLHFIRQSHPRGLGDAVLQAKAFVGNEPFVVMLGDDLMDITNDKAMPLTKQLMNDYEATHASTIAVMQVPHEEVSSYGVIAPQGEGLNGLYSVEKFVEKPSPEEAPSDLAIIGRYLLTPEIFKILENQAPGAGNEIQLTDAIDTLNKTQRVFAREFKGDRYDVGDKFGFMKTSIDYALKHPQVKDDLEQYIIELGKKLEEKTKK

SEQ ID NO: 12406 - protein, 468 aa, Sporochnus scoparius
IPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVIVERERLDKFGRPFLGATVKPKLGLSGKNYGRVVYEGLCGGLDFLKDDENINSQPFMRWKERYLYCMEGVNRAAAATGEVKGSYLNVTAATMEQMYERAEFANDLGTVIVMVDLVMGYTAIQTLAIWARKAQMILHLHRAGNSTYARQKNHGINFRVICKRMRMCGVDHIHAGTVVGKLEGDPLMVRGFYNCLLLTQLKINLAEGLFFDMDWASLRKCVPVASGGIHCGQMHQLLYYLGDDVVLQFGGGTIGHPDGIQAGATANRVALEAMVLARNEGRDYVGEGPEILRHAATTCGPLKAALDLWKDITFDYTSTDTPDFVEVATESK

SEQ ID NO: 12407 - protein, 344 aa, Burkholderia fungorum
MKTHMQAAVVEQFGKPLVLKELAIPTPGPGQVLVKTEACGVCHTDLHATNGDWPLKPGLPFTPGHEGIGIVAALGAGVTAVKEGDRIGVPWLYSACGHCEYCLAAREPVCAEAQFGGYTKNGGFAEYIVADPNYVAHIPAGLAAREAAPLICAGITSYKGIKETQARPGEWVVISGVGGLGHLGIQYAKAMGLQVCAVDIDDGKLAHAKRLGADAVVNANDGDPIAAVIRATGGGAHGVLITAPSLGAFKQGVGMTRKCGTCVLVGLPPGEFPTPLFDVVANCITIRGSFVGNRRDMAEALAFAADGKVRADIELQPLSAINNVFQRLGHGDVPSRVVLEFASH

SEQ ID NO: 12408 - protein, 86 aa, Glycine max
KNNCLIGADDFKSGQTKMKSVLVDFLVGAGIKRTSIVSYNHLGNNAGMNLSAPQTFRSKEISKINVVDDMVSSNAILYEPGEHPDH

SEQ ID NO: 12409 - protein, 485 aa, Glycine max
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIEDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 12410 - protein, 367 aa, Oryza sativa; identical to SEQ ID NO: 4465

SEQ ID NO: 12411 - protein, 380 aa, Triticum aestivum
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 12412 - protein, 237 aa, Bidens pilosa
EREGVTHVFAYPGGASLEIHQDLTCTTLVQNILPRHEQGAIFAAEGYAHASGLPGVCMATSGPGATNLFSGFADALLDSVPIVAITGQVPRRMIWTDAFQETPIVEITRSITKHSYLLLDVDDIPRIVREAFYLANSGRPGPILIDVPKDIQQQLTVPKWDSPMRLADYDARLPKPPKDNQLRQIIRLVSGSKRPVLYVGGGCLNSGDELRRFVELTGIPVASTLMGLGSYPGSSDL

SEQ ID NO: 12413 - protein, 327 aa, Trichodesmium erythraeum IMS101
MTHPYAICLGEILFDCLADQAEKTFNKVESWTTYPGGAPANVACGLVNLGTTAALISSVGEDTEGKKLVQILQEIGVDTSGIQGHPYAQTRKVYVLRSKTGEREFAGFGKQTTTEFADTYLKAELLPESLFLNGEFLILGTLGLAYPQTRQAIYQALDLADRYHLKIMVDVNWRPSFWPNPDDAKPLIQSILKRSDFVKLSLEEAEWLFDCTDPAAITYRLDSVEGLLLTAGNQGCAYYLSENEGKVPAFSVDAVDTTGAGDGFVAGFIHQLRQYGIRRLQQPGVAKQIVTYASAVGAITTTKLGAVTAQPTESEVEAFLGSYLPKN

SEQ ID NO: 12414 - protein, 358 aa, Rhizobium sp. NGR234
MMREYSIATIPADGIGPEVIAAGRTVLATLEKRLGDVKFTVENFDWGSDYYRKHGVMMPSDGLEQLKKFDAIYFGAVGAPDVPDHITLWGLRLPICQGFDQYANVRPTKILPGITSPLRNCGPGDLDWVIVRENSEGEYSGHGGRAHRGLPEEVGTEVAIFTRVGVTRIMRYAFKLAQSRPRKLLTVVTKSNAQRHGMVMWDEIAAEVAEEFPDVTWDKMLVDAMTVRMTLKPQSLDTIVATNLHADILSDLAGALAGSLGVAPTANIDPERRFPSMFEPIHGSAFDITGKGIANPVATFWTAAQMLDHLGEQDASARLMRAVERVTGARILTPDVGGTATTREVTEAVCDAIHSSNV

SEQ ID NO: 12415 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEKAXXXXXRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 12416 - protein, 145 aa, Zea mays
MSHRRDYGSDAVHVRITHDPPPENCFPNSGDSSVWATEDDYSRVWAINSDGAESPSKKTRSSSSSEIGKSFFKTKLCFKFRAGTCPYSASSCHFAHSAEELRLPPPPPPNWQETVTEASRNRESFAGCFCPPPGKCKQFPLGTRE

SEQ ID NO: 12417 - protein, 557 aa, GIBBERELLA ZEAE PH-1
MGGAPTTVGTYDAALQRRQALMGASGARALVKNWKVFRIAAFACIGGILYGYNQGMFSGILVMKSFERHMGDYVQNKTKKGWLTSILELGAWLGTLMSGAIAELCSRKYGILIATSVFIIGVVIQCTAMQAGHNAILAGRFITGMGVGSLSTIVPLYNSECAPPEVRGALVALQQLAITFGIMVSFWIDYGTHFIGGTGEGQSDAAWLIPVCLQLGPAIILFIGIMWMPFSPRWLTHHNREEEARQVLANLRDLPTDHELIELEFLEIKAQSLFEKRSLAEKFPHLQEQTAGNTIKLQFVAIAALFKTKAMFKRVIVATVTMFFQQWTGINAIFEQLGLSSNTTSLLATGVVGIVMFIATIPAVLWIDRLGRKPVLAVGAIGMGLCHLIIAVILARNIDQFDTHPAAGWAAICMVWLFVVHFGYSWGPCAWIIIAEIWPLSTRPYGVALGASSNWMNNFIVGQVTPEMLDGITYGTYILFGLLTMIGAAFIWFFVPETKRLSLEEMDIIFGSEGAAQADNERMAEINREIGLDDLIYRSGAVHSNEDIHQDVKDVKE

SEQ ID NO: 12418 - protein, 188 aa, Campylobacter jejuni subsp. jejuni NCTC 11168
MKKILFIDNYDSFSYTIIYYLKELSFECKVIKNDGFKKAKELEKFDFTHLIISPGPHSPKESKLSLKAIKYFKKNKKILGICLGHQCIAEIFGGRVSKMQNPMHGKISKLYFKKDPIFKGIKKEIEICLYHSLHISSMPEKCKILAHNSENIIMAIKHKKYPIYGLQFHPEAVLTQKGKKILKNFMKL

SEQ ID NO: 12419 - protein, 118 aa, Glycine max
MAISMISSRADTTVNRAGAGMVATFTGLKFMAGLPTRKTNNDITSIASNGGRVQCMQVWPPIVKNKFETLSYLPDLDDSQLAKEVEYLIMKRWIPCLEFELEHGFEYREHNRSPGYYD

SEQ ID NO: 12420 - protein, 256 aa, Pantoea agglomerans
  unsure (1)..(256): unsure at all Xaa locations
GAAGGIGQALALLLKTQLPAGSELSLYDIAPVTPGVAVDLSHIPTAVAIQGFSGEDATPALQGADVVLISAGVARKPGMDRADLFNVNAGIVRNLIEQVATTAPKALIGVITNPVNTTVAIAAEVLKKHGVYDKNRLFGVTTLDIIRANTFVAALKGKQPDQVEVPVIGGHSGVTILPLXSQVKGVSFSDQEVADLTKRIQNAGTEVVEAKAGGGSATLSMGQAAARFGLSLVRALKGEANVVECAYVEGEGEHAR

SEQ ID NO: 12421 - protein, 409 aa, Nicotiana tabacum
MTSVGLAPVSGLRESSSHSVGVDRLPEEMNDMRIRDDKEIEAAIVDGNGTETGHIIVTTIGGRHGQPKQTISYMAERIVGQGSFGVVFQAKCLETGETVAIKKVLQDKRYKNRELQTMRLLDHPNVVCLKHCFFSTTEKDEVYLNLVLEYVPETVHRVIKHYNKLNQRMPLILVKLYTYQIFRALSYIHHTIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKVLGTPTREEIKCMNPNYNEFKFPQIKAHPWHKIFHKRMPPEAVDLVSRLLQYSPNLRCTALEAVTHAFFDELRDPNTRLPNGRVLPPLFNFKAHELKGVSAENLLKLVPEHARKQCPSLGL

SEQ ID NO: 12422 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKESQ

SEQ ID NO: 12423 - protein, 486 aa, Burkholderia fungorum
MTPQGACMEEARHFIGGEWSAASGGETIAVLDPSDGQPFTQLARGTAADIDAAVHAARRAFEGAWGEASAAERGRVLYRLSMLVAARQEELALLEARDTGKPLKQARADSAALARYFEFYAGAADKLHGETLPYQTGYTVLTIRDPHGVTGHIVPWNYPMQIFGRSVGAALAAGNACVVKPAEDACLSVLRVAELAAEAGLPAGALNIVTGYGHEAGAALARHPGIDHISFTGSPETGKLVTQMAAENHVPVTLELGGKSPQIVFADADLDAALPVLVSAIVQNAGQTCSAGSRVLIDRSIYEPLLDRLSGAFHALRVGPSHADLDCGPLISAKQQRRVWDFLSDAQHDGIPMAAHGEVIPEAPESGFYQAPTLLRDVPASHRLARDEVFGPVLAAMSFSGEDEALALANGTPFGLVAGIWTRDGARQMRLARRLRSGQVFINNYGAGGGVELPFGGVKHSGHGREKGFEALYGFTVLKTIAIRHG

SEQ ID NO: 12424 - protein, 154 aa, Triticum aestivum
  unsure (1)..(154): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDAXQVINEVEESRRSXPDAYVRSSDHNVGW

SEQ ID NO: 12425 - protein, 143 aa, Chlamydomonas reinhardtii
LIYSVHAEQSSTIHLHRTLNMVKDLGCKAGVVLNPGTSLSTIEEVLDVVDLILIMSVNPGFGGQKFIESQVAKIRNLKRMCNEKGVNPWIEVDGGVTPENAYKVNSMTGANALVAGSAVFKAKSYRDAIHGIKVSKAPANVMA

SEQ ID NO: 12426 - protein, 519 aa, Saccharomyces cerevisiae
MLSRTRAAAPNSRIFTRSLLRLYSQAPLRVPITLPNGFTYEQPTGLFTNGEFVASKQKKTFDVINPSNEEKITTVYKAMEDDVDEAVAALKKLLKRSVYCRAGVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 12427 - protein, 555 aa, Schizosaccharomyces pombe
MNRFITSILVVFISMSGWLQGADTGSISGILGMRDFQSRFADRYNPISNSYSYSAWRQALLTGTINAGCLFGAMLSSPFTERIGKKYSICFFSGVYIIAELLLVTAVPSWIQVLVGKILAGVGIGALSVLSPGYQSEVAPPQIRGAVVATYQIFSTGAALVAACINMGTHKLRKTASWRTSFGINMLWGILLMVGVLFLPESPRYLIYKGRDEEALRIMCNMAELSPESEIIQTNFNTIKSDIEIEMAGGKARWIEIFGKDIRYRTCLGFLVMLFRELIGNNYYFYYATQVFKGTGMTDIFLPAVILGAINFGTTFGALYTIDNLGRRNPLIFGAAFQSICFFIYAAVGDRKLIYKNGTSDHRAGSVMIVFSCLFLFSYCCSWGPMGWVIVGETFPIRYRSKCASVATSGNWLGNFMISFFTPFINNAIGFKLGYIYACINLFSSFMIFFLAKETKGLTLEEVNDLYMSNIKPWESYKYVREIESHRIHFSKEEEKREREKSKGIRGQEEEFIENADEDNNDSSSSSGSVVSAVKPRRSAVSNDRFSEDSHPTYI

SEQ ID NO: 12428 - protein, 341 aa, Actinomadura hibisca
MTEPEGPHAASLRLQSLLDGMRVAKVVQVLAELQVADAVADGPCKPAEIAADVGADPDALYRVLRCAASFGVFTEDEDGRFGLTPMAALLRTGTDDSHRDLFMMAAGDLWWRPYGELLETVRTGRPAAELAFGMPFYDYLGTDPAAAGLFDRAMTQVSKGQAKAILGRCSFERYARIADVGGGHGYFLAQVLRSSPRTEGVLLDLPHVVAGAPAVLEKHEVADRVQVVPGSFFDALPTGCDAYLLKAILINWPDADAERILHRVREAIGTDRDARLLVVEPVVPPGDVRDYSKATDIDMLAIIGGRQRTVAEWRRLLRAGGFELVGEPTPGRREVMECRPI

SEQ ID NO: 12429 - protein, 352 aa, Rhodococcus sp. Phi2
MRVFAVQPEDTTIHDLQVPTPSPEGREVLLRVVRAGVCHTDTHLRAGGYDLGSRGMMSMKERGIEYPMVLGHEVVGVVEKVGDGVESVQVGDIRLIYPWIGCGECRQCRAGHDNRCAAGKNLGVARHGGYAENILVPDEKYLVDIDGLDPSWAATLACSGLTAYSAVDKALPLEPDEPVVVFGAGGLGLTAIAILRSRGHRNICAVDVAERNLALARDMGASSTVLSGTGSGADDIRGAAGGPAGAVIDFVNNGATATTAFEVLAKAGIMIQVGLFGGEVTLPTALLALRMIRIEGSFVGTLVQMQDLVRLAQRGELPHIPVVERSLSAAAVSQALDDLTAGGVAGRIVLTA

SEQ ID NO: 12430 - protein, 355 aa, Eucalyptus botryoides
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCGPCNSDQEQYCNKKIWNYNDVYTDGKPTQGGFAGEIVVGQRFVVKIPDGLESEQDAVMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 12431 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPGEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 12432 - protein, 383 aa, Picea abies
SRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEELTKPFKEAMAFLKKIENQLGALTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 12433 - protein, 239 aa, Oryza sativa (japonica cultivar-group)
MGRGKVVLQRIENKISRQVTFAKRRNGLLKKAYELSILCDAEVALVLFSHAGRLYQFSSSSNMLKTLERYQRYIYASQDAAAPTSDEMQNNYQEYVNLKAHVEILQQSQRNLLGEDLAPLATNELEQLESQVVRTLKQIRSRKTQVLLDELCDLKRKEQMLQDANRVLKRKLDEIDVEAAPPQPPWNGNCSNGHGGGGGVFSSEPPQPEHFFQALGLHAVDVNQPPAPPPGGYPPEWMA

SEQ ID NO: 12434 - protein, 128 aa, Glycine max
TRPDLLTCRAESCVVDCHDVQLAIQCKVNFSFSQPPPREVLLELAQNRNKIPLPKTIAGPGIPLPPDQDTLISPNYQFAIPNKRPAQPLEETEDEEATIPNPSQEQKVDTQPNPHQRVSFPLPKRQKD

SEQ ID NO: 12435 - protein, 901 aa, Medicago truncatula
MELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 12436 - protein, 362 aa, Vibrio cholerae
FTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTTTFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGYDGI

SEQ ID NO: 12437 - protein, 336 aa, Pyrobaculum aerophilum str. IM2
MSVVGSFEQLERLRDLFYKLLDLRDTLRERGVAWPKPLSEEAALGTVRVKVGFPAMLKRGVIMDVTNVEQAQIAEDAGAVGVMVLDKLPYDVRRAGGVARMADLKVIEEVMAHVTIPVSAKVRIGHYYEAFLLEQVGVDLIDESEVLTPVDEQHHINKWMFTVPFVNGARELCEALRRISEGASMIRSKGEAGTGNVAEAVKHFKSIYGAIKSLAAGDEERVRDFARQCQVPFELVALTAKLQRLPVITFAAGGIATPADAALMMWLGADGVFVGSGIFKSQDPRERAEAIVLATAHWDDPETVVEAQKMVSERGAMMGIDIRTLKPEELLQTRGV

SEQ ID NO: 12438 - protein, 513 aa, Populus balsamifera subsp. trichocarpa
MDSLLQSLQTLPMSFFLIIISSIFFLGLISRLRRRSPYPPGPKGFPLIGSMHLMDQLTDRGLAKLAKQYGGLFHMRMGYLHMVAGSSPEVARQVLQVQDNMFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 12439 - protein, 418 aa, Fagus sylvatica
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQDHMLELLNQLDGFESIKQIKVLMRTNRIDILDQALLRPGRIDRKIEFPNPNRESRFDILKIHSRRMNLMRGIDLKKIAEKMNGASGAELKAVCTEAGMFALTAERRVRLVTQEDFEMAVAKVMKKETEKNMSLRKLWK

SEQ ID NO: 12440 - protein, 752 aa, Streptococcus pneumoniae TIGR4
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAVVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERFYNELINKDWFMTLLDLEDYIKVKEQMLADYEDRDAWLDKVIVNISKAGFFSSDRTIAQYNEDIWHLN

SEQ ID NO: 12441 - protein, 348 aa, Catharanthus roseus
MEVQSVEFCKAQAHIWNQVFSFTTCASLKCAVQLGIADAIDDHGKPMSLFYLTKALQINPSKAPYIQRLMGILVNSGFFSQDKLSYYSLTPSSRLLLKKEELNLRGAVEIMLDPAELKAWSSLSDWFKDEKCRTTFEMAHGKNFWDFCAEESIHGEIFNRAMSTDSQLISKLLVTEYKFLFEGLTSLVDIGGGTGTIAKAIAKSFPKLKCTVFDLPHVVANLESKENLEFVGGDMFERIPNANAILLKIVLHNWNDEDCMKILKKCKEAILGKEKSGKVIIIDIVMDSKKEDYESLQAQISMDLQMMVLLDAKERREKEWAILFQKSGFSGYKIFSMFDYRSIIEVYP

SEQ ID NO: 12442 - protein, 143 aa, Oryza sativa (japonica cultivar-group); identical to SEQ ID NO: 9656

SEQ ID NO: 12443 - protein, 522 aa, Oryza sativa
MTGSVPFEKALAARLSLFKPSLGQVEDCMEKRPPRISPGIAELVKMLKAKNVDVYLVSGGFRQMIKPVAMQLGIPPENIFANQLLFGTSGEYVGFDPSEPTSRSGGKAVAVQNIRQKCGYRTLFMVGDGATDLEARQPNGADLFICYAGLALARSIVRRVSETELTFIGDGMSYCLGKKGYQAVHRHYSPPQAAAGDGGAPLRVPGARAAQRGLTWLEGRKIRCLLLAKHPVVESHELKLLQIVDAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNS

SEQ ID NO: 12444 - protein, 461 aa, Corynebacterium glutamicum ATCC 13032
MVTPIMGNSNSILGIYRQKIQNRHLVSTLFRAYFPIVTELIILLIVIVTALAFDFTNGFHDTGNAMATSIATGALKPKVAVALSASLNLVGAFLSVEVATTVAKGVVDLDQFDLSNAWDSHQLLLVVFAGLIGAIVWNLLTWLLGIPSSSSHALFGGLIGAAIASLGFGGVVWEGVLSKMIIPALAAPVVAGLVAAIGTFAVYSITKAVGDNEKNRYFRWGQIGSASLVSLAHGTNDAQKTMGVIFLSLVATGHLGTDADIPFWVKATCALAIAIGTYLGGWRVIRTLGKGLVEIDSPQGMAAETSSAAIILTSSHFGMALSTTHVATGSIMGTGIGRKGAKVRWSVAGRMAMAWVITLPASAIVGVFCWWVAHGIGLISSDLLGVLVAFAILVILSGYIYARSRRVPVDPSNVNADWNEESNSVEPATPSAPAASEITEAPAAPAAQAVQDLNNENEVTK

SEQ ID NO: 12445 - protein, 295 aa, Staphylococcus epidermidis ATCC 12228
MSKIVGSDRVKRGMAEMQKGGVIMDVVNAEQAKIAEEAGAVAVMALERVPSDIRAAGGVARMANPKIVEEVMNAVSIPVMAKARIGHITEARVLESMGVDYIDESEVLTPADEEYHLRKDQFTVPFVCGCRNLGEAARRIGEGAAMLRTKGEPGTGNIVEAVRHMRRVNSEVSRLTVMNDDEIMTFAKDLGAPYEVLKQIKDNGRLPVVNFAAGGVATPQDAALMMELGADGVFVGSGIFKSEDPEKFAKAIVQATTHYQDYELIGKLASELGTAMKGLDINQISLEERMQERGW

SEQ ID NO: 12446 - protein, 354 aa, Pseudomonas putida KT2440
MALISMRQMLDHAAEFGYGVPAFNVNNLEQMRAIMEAADKTDSPVIVQASAGARKYAGAPFLRHLILAAIEEFPHIPVCMHQDHGTSPDVCQRSIQLGFSSVMMDGSLGEDGKTPTDYEYNVRVTQQTVAMAHACGVSVEGELGCLGSLETGMAGEEDGIGAEGVLDHSQMLTDPEEAADFVKKTQVDALAIAIGTSHGAYKFTKPPTGDVLAIDRIKEIHKRIPNTHLVMHGSSSVPQEWLAIINQYGGDIKETYGVPVEEIVEGIKHGVRKVNIDTDLRLASTGAMRRLMAQNPSEFDPRKFFGETIKAMRDVCIARYEAFGTAGNASKIKPISLEGMYQRYLKGELAAKVN

SEQ ID NO: 12447 - protein, 340 aa, Zea mays
MRPSLLKSTAELLRRSRGYASTANPERKVAILGAAGGIGQPLSLLMKLNPLVSSLSLYDIAGTPGVAADVSHINSPALMKGFMGDDQLGEALEGSDIVIIPAGVPRKPGMTRDDLFNINAGIVKALCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNDFEKKGLESLKVELKSSIEKGIKFAHGN

SEQ ID NO: 12448 - protein, 430 aa, SYNECHOCOCCUS SP. WH 8102
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 12449 - protein, 219 aa, SYNECHOCOCCUS SP. WH 8102
MPTPARVVLGCALVLLTLTLFNAGLAESITPELERAEVLCGMASVGLMLVAVLWTRADPTQAKPRPLSGEQGLQLDPDLDEAIREELAWGSHMLLTATPAATLLVFWRDQVLLRRGLLGDGDKAFTPGPICRRAMDRQTPISLVNTTLFPGRHEFDPVLDNLPAVLIVPLASEGVLILGGWSERCFSQADEQWLEGWGARLRTKLEGVTMEGRCGIDPA

SEQ ID NO: 12450 - protein, 366 aa, Glycine max
  unsure (1)..(366): unsure at all Xaa locations
MKGRFMFLSVLLCATFHVSFSIIDGLVANGNFELGPKPSALKGTVVVGGSHSIPEWEISGFVEYIKSGQKQGDMLLVVPEGAYAVRLGNEASIKQRIKVIKGMYYSITFMVARTCAQEERLNISVTPDWGVIPIQTLYTSSGWDPIAFGFKAESETVEMLIHNPGKEEDPACGPLVDSVALRTLYPPKATNQNILKNGGFEEGPYVFPNSSWGVIIPPNIEDDHSPXPGWMVESLKAVKYIDSDHFSVPQGKRAVELIAGKESAIAQVARTIPGKTYVLSFSVGDASNSCEGSMIVEAFAGKDTIKVPYESKGNGGFKRAALKFVAVTPRTRVMFLSTFYTMRSDDFSSLCGPVIDDVKLVSLRKP

SEQ ID NO: 12451 - protein, 847 aa, Oryza sativa
MRKEHSLSVCTREHIIHDVENDGAPPPPPRRRRRRGLSCSGEATPRPPRRGKVSRLIPRGFSFDFDFAISSGVRRVTVCNRIRDGAVVLINPVNLFRLNSLKLRTSLVLEPYVVDESSQLCFWVGVLMIVLLQDQWKSYCRTISLLAFQSFGVVYGDLSTSPLYVYKSAFSGRLNNYRDETTIFGLFSLIFWTLTLLPLLKYVIIVLNADDNGEGGTFALYSLLCRHAKFSLLPNQQSADEELSTYYQPGVGGIISSPLKRFLEKHRKLRTCLLLFVLFGACMVIGDGVFTPAISVLSAISGLKDPGPGGIPDGWVVFIACIVLVGLFALQHRGTHRVAFMFAPIVVVWLLSIGVIGLYNIIHWNHRIFLALSPHYVIKFFKMTGKDGWLSLGGVLLAITGSLFWPVFVIATLAAVVGSQSIISATFSIVKQCLSLGCFPRVKVVHTSRWIHGQIYIPEINWILMVLCLAVTLGFRDTTVIGNAYGLACIVVMFVTTWLMALVIIFVWQKNILLALLFVVAFGSIEVVYLSAAVTKVPQGGWAPIVFAFVFMLVMYVWHYGSRRKYLFDLQNKVSMKWILTLGPSLGIVRVPGIGLIYTELVTGVPSIFSHFVTNLPAFHQVLVFVCVKSVPVPFVPEDERYLIGRIGPREYRMYRCIVRYGYKDVQKDDENFENHLVMSIAKFIQMEAEEAASSGSYESSEGRMAVIHTEDTTGTGLVMRDSNNEASGTSLTRSSRSETLRSLQSIYEQESGSLSRRRRVRFEIAEEERIDPQVRDELADLLDAKEAGVTYIIGHSYVKARKNSNFLKTFAIDYAYSFLRKNCRGPAVALHIPHISLVEVGMIYYV

SEQ ID NO: 12452 - protein, 203 aa, Ranunculus ficaria
KRRNGLLKKAYELSVLCEAEVALIVFSNRGRLYEYANNSVRKTIDRYKKQCSDASTALTVSEANSLFYQQESSKMKQQIDILQNSNRHLMGEALSCLSIKELKQLESRLEKGLSRIRSKKNEMLLAEIEYVQKREIDLHNDNVYLRQKISENERAQQHMNSLPGNAYEAMTSAPYDARNFLQVNLSDNKDNHYGSSSTALQLC

SEQ ID NO: 12453 - protein, 540 aa, Solanum tuberosum
MANDLQVLNALDVAKTQLYHFTAIVIAGMGFFTDAYDLFCISMVTKLLGRIYYHHDNALKPGSLPPNVSAAVNGVAFCGTLAGQLFFGWLGDKMGRKKVYGMTLMIMVICSIASGLSFGHTPKSVMTTLCFFRFWLGFGIGGDYPLSATIMSEYANKKTRGAFIAAVFAMQGFGILAGGMVAIIVSSAFKGAFPAPAYEVDALASTVSQADFVWRIILMFGAIPAGLTYYWRMKMPETARYTALVAKNLKQAANDMSKVLQVEIEAEPEKVAAISVANGANEFGLFSKEFLRRHGLHLLGTASTWFLLDIAFYSQNLFQKDIFSAIGWIPPAQTMNALEEVYKIARAQTLIALCSTVPGYWFTVAFIDRIGRFAIQLMGFFFMTVFMFALALPYHHWTLKDNRIGFVVMYSLTFFFANFGPNATTFVVPAEIFPARLRSTCHGISAAAGKAGAMVGAFGFLYAAQPTDPKKTDAGYPAGIGVRNSLIVLGCVNFLGMLFTFLVPESKGKSLEEMSRENEGEEETVAEMRATSGRTVLFKF

SEQ ID NO: 12454 - protein, 554 aa, Triticum aestivum
  unsure (1)..(554): unsure at all Xaa locations
MAAAAAGATRRAASSLASRCLLSRPAASPAAVPSALRRADGARGLLPGLLQRFGTAAAAEEPISPSVQVGETQLLINGKFVDAASGKTFPTLDPRTGEVIARVSEGDAEDVDRAVVAARKAFDEGPWPKMTAYERSRILLRFADLIEKAQXDKIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTAKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKXGYYIQPTIFSGVQDGMKFAQEXIFGPVQSIFKFNDLNEVIKRANASQYGLAAGVFTNNLDTANTLTRALRAGTVWVNCFDIFDAAIPFGGYKMSGIGREKGIDSLKNYLQVKAVVTALKNPAWL

SEQ ID NO: 12455 - protein, 220 aa, Streptomyces globisporus
MSLWSPDGSGAGTEAPRVLVVDAFDSFVDILRQYLMSAGAEPVMVRSHLMTPDEMGLMRPDAVLLGPGPGHPDTSGHVEIVQAFAGRVPLLGVCLGHQAVARAYGAATVPARHLMHGKTSRITHDGRGVFTGLPAGFFATRYHSLIVPEGTVPPSLEVTARSTDDGYVMGLRHRSLPVESVQFHPESFRTEHGMPMIRNFLSSVRSFSAREGAAAPAEAA

SEQ ID NO: 12456 - protein, 212 aa, Nostoc punctiforme
MNKPDPNRVLRRLPIVVGGLGAVLLLINRLLTPELTQSQSRGDVVGVILSAVLILTGLIWQQVQPRSPDIVELIGEEGFVLAADLPETVKTELAWASHLLLTNTVTRSLVVYYQGKVLLRRGILGTKSEVVPGVILKQVLEKQKPIYLVALKIYPGRLEFDYLPENTQGVICQPIGNQGALILGANAPRSYTKQDENWIAGIADKLAVTLST

SEQ ID NO: 12457 - protein, 492 aa, Gossypium hirsutum
MDPYKHRPSSAFNSPFWTTNSGAPVWNNNSSLTVGPRGQYLLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDLGVPQDYRHMEGSGVNTYTLINKAGKAHYVKFHWKPTCGVKCLLEDEAIKVGGANHSHATQDLYDSIAAGNYPEWKLFIQTIDPDHEDKFDFDPLDVTKTWPEDILPLQPVGRLVLNKNIDNFFAENEQLAFCPAIVVPGIYYSDDKLLQTRIFSYSDTQRHRLGPNYLQLPANAPKCAHHNNHHEGFMNFMHRDEEINYFPSRYDPVRHAEMFPIPPAVCTGRREKCIIEKENNFKQPGERYRSWAADRQERFICRWVDALSDPRVTHEIRSIWISYWSQADKSVGQKLASLLNVRPSI

SEQ ID NO: 12458 - protein, 182 aa, Arabidopsis thaliana
YPYIAGMGVYCFKTEALLKLLTWRYPSSNDFGSEIIPAAIKDHNVQGYIYRDYWEDIGTIKSFYEASIALVEEHPKFEFYDQNTPFYTSPRFLPPTKTEKCRIVNSVISHGCFLGECSIQRSIIGERSRLDYGVELQDTLMLGADSYQTESESRLLAEGNVPIGIGRDTKIRKCIIDKNARI

SEQ ID NO: 12459 - protein, 464 aa, ASPERGILLUS NIDULANS FGSC A4
MTPLIYLPGRVRSAHAVRCSLLKSPLQHPFRSSYPLSLHKRWSTSLSQRPGSDRVRFPGAVNSKFTTEMAFINPMDKPGIPTYRVMDSDGVLIDKSRSELSVSNEEALAWYRNMLTVSIMDVIMFEAQRQGRLSFYMVSAGEEGISVGSAAALTPDDVVFAQYRETGVFQQRGFALKNFMSQLFANANDNGRGRNMPVHYGCEYPKTHTISSTLATQIPQASGAAYALKLQALQNPDTPPRIVACYFGEGAASEGDFHAGLNIAATRSCPVVFICRNNGYAISTPTLEQYRGDGIASRGVGYGIDTIRVDGNDIFAVYEAMKAARTLALSQGGKPVLIEAMSYRVSHHSTSDDSFAYRARVEVEDWKRRDNPIIRLRKWLENEGIWNEDMERQARESIRKEVLREFGEAERAKKPAIRFAFEDVYDEVTEEAREQMKELRRILEEYPEEYDLRSFEGGVKGLDS

SEQ ID NO: 12460 - protein, 426 aa, Prunus avium
MAGICCGVVGEAEASTTIEASSRNSRRRRLELLPLKYIADMAVKPSTVENSRKRQKIDLYRSSSSVPHNAVESSSEAKSKSESEGSKLNATVRFGDDDFDAVNTRGDHQESKSVRVDNEAVQVQALQGSPRFGMTSVCGRRRDMEDAVSIHPSFYQNDGPDSNGAHFYGVFDGHGCSHVALKCKDRLHEIVKQELETEGGYIQWKGAMERSFAKMDDEVQEGNLVAQGPNCRCELQTPQCDAVGSTAVVAVVTPEKIIVSNCGDSRAVLCRNGVAVPLSSDHKPDRPDELVRIEAAGGRVIYWDGARVLGVLAMSRAIGDNYLKPYVISEPEVTIMDRSAEDECLILASDGLWDVVSNDTACGVVRMCLRAQKTTSHSESSGRDAAVRSDKACSDASILLTKLALARQSSDNVSVVVVDLRRPGRC

SEQ ID NO: 12461 - protein, 699 aa, Arabidopsis thaliana
MAPKFEWWAKGNNNNTRKGTPVVVKMENPNNWSMVELESPSHDDFLVRTHEKSRNKNARQLTWVLLLKAHRAAGCLTSLGSALFALGTAVRRRIAAGRTDIEISSSGVGSLQKQNHTKKSKLFYSCLKVFLWLSLILLGFEIAAYFKGWSFGTSKLQLQFIFNKGFFDWVYTRWVLLRVEYLAPPLQFLANGCIVLFLVQSLDRLILCLGCFWIRFKKIKPVPKPDSISDLESGDNGAFLPMVLVQIPMCNEKEVYQQSIAAVCNLDWPKGKILIQILDDSDDPITQSLIKEEVHKWQKLGARIVYRHRVNREGYKAGNLKSAMNCSYVKDYEFVAIFDADFQPLPDFLKKTIPHFKDNEEIGLVQARWSFVNKEENLLTRLQNINLAFHFEVEQQVNSVFLNFFGFNGTAGVWRIKALEDSGGWLERTTVEDMDIAVRAHLHGWKFVFLNDVECQCELPESYEAYRKQQHRWHSGPMQLFRLCLPAVIKSKISIGKKFNLIFLFFLLRKLILPFYSFTLFCIILPMTMFVPEAELPAWVVCYIPATMSFLNILPAPKSFPFIVPYLLFENTMSVTKFNAMVSGLFQLGSAYEWVVTKKSGRSSEGDLAALVEKDEKTTKHQRGVSAPETEAEKKAEKTKRKKKKHNRIYMKELSLAFLLLTAATRSLLSAQGIHFYFLLFQGISFLLVGLDLIGEQVE

SEQ ID NO: 12462 - protein, 210 aa, Zea mays
MFGYRKADPDLEAGGSSLLYPGMTESPVSNFFVSSNAGVALYIFLIILPFLVLCPLRYYHQKHPVNLLLLGLFTVAISFAVGMTCAFTSGKIILEAAILTAVVVISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 12463 - protein, 185 aa, Oryza sativa (japonica cultivar-group); identical to SEQ ID NO: 9084

SEQ ID NO: 12464 - protein, 500 aa, Saccharomyces cerevisiae
MSFENLHKVNAEALEDAVVEICSSLQVDAAKLDELTAYFIECMEKGLNNTSVGEEKTVDKGLPMIPTYVTSLPNGTERGVLLAADLGGTHFRVCSVTLNGDGTFDMQQLKSKIPEEYLNDKDVTSEELFSYLGRRTRAFVRKHHPELLKSTGENIKPLKMGFTFSYPVDQTSLSSGTLIRWTKSFKIEDTVGKDVVRLYQEQLDIQGLSMINVVALTNDTVGTFLSHCYTSGSRPSSAGEISEPVIGCIFGTGTNGCYMEDIENIKKLPDELRTRLLHEGKTQMCINIEWGSFDNELKHLSATKYDIDIDQKFSPNPGYHLFEKRISGMYLGELLRNILVDLHARGLILGQYRNYDQLPHRLKTPFQLCSEVLSRIEIDDSTNLRETELSFLQSLRLPTTFEERKAIQNLVRSITRRSAYLAAVPIAAILIKTNALNKRYHGEVEIGFDGYVIEYYPGFRSMLRHALALSPIGTEGERKIHLRLAKDGSGVGAALCALVA

SEQ ID NO: 12465 - protein, 251 aa, Pseudomonas syringae pv. tomato str. DC3000
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 12466 - protein, 440 aa, Candida albicans [sequence omitted]

SEQ ID NO: 12467 - protein, 58 aa, Oryza officinalis
KGKLPKDARQQLLNWWELHYKWPYPSESQKVALAESTGLDLKQINNWFINQRKRHWKP

SEQ ID NO: 12468 - protein, 77 aa, Zea mays
RSSWGDPEIKLFEFYKVEDPEHLFGEDQGWASGISAPAVQGLLEVLGEGGADNVSQGFLEATPYGSTELGRVLLQES

SEQ ID NO: 12469 - protein, 489 aa, Mycobacterium tuberculosis H37Rv
MALWGDGISALLIDGKLSDGRAGTFPTVNPATEEVLGVAADADAEDMGRAIEAARRAFDSTDWSRNTELRVRCVRQLRDAMQQHVEELRELTISEVGAPRMLTASAQLEGPVGDLSFAADTAESYPWKQDLGEASPLGIATRRTLAREAVGVVGAITPWNFPHQINLAKLGPALAAGNTVVLKPAPDTPWCAAALGEIIVEHTDFPPGVVNIVTSSSHALGALLAKDPRVDMISFTGSTATGRAVMADAAATIKKVFLELGGKSAFVVLDDADLAAASAVSAFSACMHAGQGCAITTRLVVPRARYEEAVAIAAATMSSIRPGDPNDPGTVCGPLISARQRDRVQGYLDLAVAEGGRFACGGARPADREVGFYIEPTVIAGLTNDARVAREEIFGPVLTVIAHDGDDDAVRIANDSPYGLSGTVYGADPQRAARIASRLRVGTVNVNGGVWYCADAPFGGYKQSGIGREMGLLGFEEYLEAKLIATAAN

SEQ ID NO: 12470 - protein, 399 aa, Brassica napus
MALKFNPLVSQPYKLASSARPPVSTFRSPKFLCLASSSSPALSSKEVESLKKPFTPPREVHLQVLHSMPPQKIEIFKSMEDRAEQNLLPHLKDVEKSWQPQDFLPDPASDGFEDQVKELRERARELPDDYFVVLVGDMITEEALPTYQTMLNTLDGVRDETGASPTSWAVWTRAWTAEENRHGDLLNKYLYLSGRVDMRQIEKTIQYLIGSGMDPRTENNPYLGFIYTSFQERATFVSHGNTARQAKEHGDLKLAQICGTIAADEKRHETAYTKIVEKLLEIDPDGTVVAFADMMRKKISMPAHLMYDGRDDNLFDNFSSVAQRLGVYTAKDYADILEFLAGRWRIESLTGLSGEGNKAQEYLCGLTPRIRRLDERAQARAKKGPKIPFSWIHDREVQL

SEQ ID NO: 12471 - protein, 268 aa, Zea mays
  unsure (1)..(268): unsure at all Xaa locations
MFGYRKAGPDLEAGGSSLLYPGMTESPELRWAFVRKIYVILAVQLAMTAAVSAFVVKVPAVSNFFVSSNAGVALYIFLIILPFLGKPGSPVFWGIFSPXAEIGCNLLRAVLCPLRYYHQKHPVNLLLLGLFTVAISFAVGMTCAFTSGKIILEAAILTAVVVISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 12472 - protein, 558 aa, Chlamydomonas reinhardtii
MGGADVQAITIAVTTGRDCAMSGDYSAGCTYYENAVELITRYVRTLGDPHAIRQWSALLKEVQDEHSSVRQCDKEARGMRVYDSVARSNSYPEMNDPRGSAAYDDGYRQPIVVCHNSGQEDPMVWRPPTRGEGRSGAPARGAPPPRARSSQDDNKLPSWANNNNGGGGGPPARGNAAGPSGRAGSAPRRPTGNAPAGNAAAGGSYDRPWRQNMQGKQGAAGPGGKPGDKGSAGEKAKKQYSGPDQELAAMLERDIVDQGTSVKWDDIAGLEEAKRVLNEALVLPMIMPDFFTGIRRPVKGVLLFGPPGTGKTMLAKAAATETSCTFFNVSSATLASKYRGESERMVRILFEMARDLAPSMIFIDEVDSLCSQRGTANEHEASRRVKTELLTQVDGVHGSEKDKEPGPDGEPPAPKHVFVLAATNFPWDIDEALRRRLEKRVYIPLPGQAQRLQLLKINLRDVAVAPDVNLEAVAGQMDGYSGDDITNVCRDAAMNGMRRLVAGKTPAEIKALREAGMTGGQEPITSDDFREALRKINPSVSKEDIKRHEEWLSVFGST

SEQ ID NO: 12473 - protein, 332 aa, Staphylococcus epidermidis ATCC 12228
MIDYKSAGLTEEDLKKIYKWMDLGRKTDERLWLLNRAGKIPFVVSGQGQEATQIGMAYAMQKGDISSPYYRDLAFVTYMGISPLDTMLSAFGKRDDINSGGKQMPSHFSHKEKGILSQSSPVATQIPHSVGAALALKMDNKPNIATATVGEGSSNQGDFHEGMNFAAVHKLPFVCVIINNKYAISVPDSLQYAAEKLSDRALGYGMHGIQVDGNDPIAVYKAMKEARERALAGEGPTLIEAVTSRMTPHSSDDDDTYRTKEERDLLKQEDCNIKFKTALLDQGIINENWLSQLETEHKELINEATKSAEAAPYPSEEEALTYVYEEGGQQND

SEQ ID NO: 12474 - protein, 278 aa, Pseudomonas aeruginosa UCBPP-PA14
MPRKVFSSQAYRHKVVLVSGGCSGIGRALALRFARAGARLAILDLDQAALDSLVQHLRDHLGGEALGLRCDVADADAVERAVALAVERFGGIDVLVNNAGITHRGTFAETGLGVFRKVMAVNFFGAVHCTRAALPSLLERRGQIVVLSSLTGFAPLLYRSAYNASKHALHGLFDTLRMELEGTGVSVTLACPGFTATDLRKNALVGDGSVTRQPVQVLGSQVASPVEVAEAIFQGAARRRRLLVLSNVNWRARLLARFFPRLFEKLLVPRLSGLKPQP

SEQ ID NO: 12475 - protein, 514 aa, Oryza sativa; identical to SEQ ID NO: 7761

SEQ ID NO: 12476 - protein, 525 aa, Bradyrhizobium japonicum USDA 110
MAPLKSVSGIIVSTFEWIIALLLGAVALSALARRIKVPYPTFLAIGGALIAFVPNSPTWTLEPDLALALFVAPVLLDAAFDTSLRDLRNNWVPVSTLVVAAVGLTTVGVAYVAHRLMPDMPWAAAIALGAIVAPPDAAAAVAILSQVKLPHRMVKVLEGESLLNDATSLLIYRIAVGAVVMQHLKWSEVAPTIALALVGSVLAGLLAGRIIPLFLQRVKEAPSAIILQFATTFMVWIAAEHLGLSGILTIVVYAITMARTAGAHMPARLRVPSYAVWETMVFVLNVLAFMLIGMQMRPIWTRLDADVRWEYCVAAAWILLTVVLVRLLWVTFYRTTLRALIAHGLYHPKDPKQVASPKGGLIISWCGMRGLVTLATAFALPENFPYRDFIVFIAFAVVLGSLVIQGLTLRPLILAFGLKDDDPVGIEVARGRAVAYRAALDAIESDPSEEAEILRLEYRAILMQADDDPNGGIASGELPADPLRRRAIEAARKSIFDLRATEVIGDDAFHRLEEELDRAELSAGG

SEQ ID NO: 12477 - protein, 544 aa, Eremothecium gossypii
MGAQDLDKQSSNSAVAEIYYESNKYGHKGDLIECSNKGPMNYIDAKNVHDDVELLAEIGYKQELKRHFSTLQIFGIAFSIMGLLPSIASVLPVALPGGSVSMVWGWFIFGAFILAVGAAMAELASAFPTSGGLYYYTYYYAPPRLKACLSFLIGNGNSLALIAGLCSIEYGLAEQILSIIAISSNSYLVSSRWLLYGIYCMGLLATVLLASIATFSVSLLQTASIVMNLALVALFIIVLPVGVAHNGRGFNSAKFMFTNFENHTGWPDWFQFFLCGSLPIVWVIGAFDSTVHMSEEAKNATRSVPIGILSSISTCWALGFAIVVVIAACMGPDIDAILNGEFNHPLAQILYNALGKGWALSVMVFIVVCQYLMGASILTASSRQIWAFARDDGLPFSSWIKVVNTKLSSPLRATWASAFVALVIGLLTLAGPTASSALFSMAVAANYLAWMTPNLLRMLFGKEIYRPGSFYMGKFWSPVINWTAILFQVFIILVMMFPSDTAGLRASTMNYTAIITGFVWIGSIFYFLAYKHRTFIGPKSNLGR

SEQ ID NO: 12478 - protein, 249 aa, Haloferax volcanii
MNRNDKQAYDRGTSLFSPDGRIYQVEYAREAVKRGAPVLGVRTADGVVLAALRSTPSELMEAESIEKLHKLDDALGAATAGHVADARKLVDFARTTAQREHLRYGEPIGVETLTKTITDNIQESTQSGGTRPYGASLLIGGVENGSGRLFATDPSGTPQEWKAVAIGGHREDVQAALEDGYAEDLSLEDGLALAVEALVAADEEIESDELNLVTVSEAGYEIVDEETIAELFADATADDESDETDEREE

SEQ ID NO: 12479 - protein, 321 aa, Oryza sativa (japonica cultivar-group)
MGLKGFVEGGAACVVAGSCTHPLDLIKVRMQLHGEGPPAPALAFPGGGAHHHHHHHLLQQQPPRRPGPIAVCAQILRAEGPTGLLSGVSATMLRQTLYSTTCMGLYDTLKRRWERDDGGGGGPLPLHRKVAAGLFSGGVGAAVGNPADVAMVRMQADGRLPAAQRRNYRSVADAIVRMARDEGVCSLWRGSPLTVKRAMIVAASQLATYDQAKEAILARRGQGADGLATHVAAGLAAGLVAASASTPVDVVKTRVMNMKVVAGAPPPYSGALDCLIKTVRSEGAMALYKGFVPTVTRQGPFTIVLFVTLEQVRKLLKGVDF

SEQ ID NO: 12480 - protein, 450 aa, Arabidopsis thaliana; identical to SEQ ID NO: 336

SEQ ID NO: 12481 - protein, 247 aa, Aquifex aeolicus VF5
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 12482 - protein, 352 aa, Pisum sativum
AGDSQTIVIGLAADSGCGKSTFMRRLTSVFGGAAEPPKGGNPDSNTLISDTTTVICLDDYHSLDRTGRKEKGVTALDPKANDFDLMYEQVKAIKDGKSVQKPIYNHVTGLLDAPELIKPPKILVIEGLHPMYDSRVRELLDFSIYLDISNEVKFAWKIQRDMAERGHSLESIKASIEARKPDFEAYIDPQKQYADAVIEVLPTQLIPDDNEGKILRVRLIQKAGVKYFSPVYLFDEGSTISWIPCGRKLTCSYPGIKFFYGPETYKGNEVSVVEMDGQFDRLDELIYVESHLSNLSSKFYGEVTQQMLKHADFPGSNNGTGLFQTIVGLKIRDLFEQIVASRAETPVGAAKA

SEQ ID NO: 12483 - protein, 246 aa, Tsuga canadensis
YTYNLRNKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHPLEPYLSLLKTNGK

SEQ ID NO: 12484 - protein, 211 aa, Prochlorococcus marinus subsp. marinus str. CCMP1375
MSELQRLKGLLPPENQSWVFIETAAAIDPPLIDLEEIGSDEVEIQIDIEQWDNLALDHRNLLFWHEVGRIQNDTIPRDGWEMAALAIGLGGAIGELWVQDGLLLLLALGLSGFAGYRLYLKNNSEKRLQDAISADERAIDLACRFGYSVPNAYKSLGGALKELIENTRKKKRRSFYENRLEALRKSAERARAEMAEQQGSKQSITSENVYG

SEQ ID NO: 12485 - protein, 419 aa, Grateloupia turuturu
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDYVAEGPQILQDAAKTW

SEQ ID NO: 12486 - protein, 692 aa, Brevibacillus brevis
MITPSFIISSFLSLPTVVEASVTNKVNYSKDVIYQIVTDRFSDGNPANNPSGAIFSQNCSDLHKYCGGDWQGIINKMNDGYLTDLGITALWISQPVENVYALHPSGYTSYHGYWARDYKKTNPYFGNFSDFDRLVSTAHNKGIKIIMDFTPNHSSLALETNPNYVENGALYNNGALLGNYSNDRNKLFHHNGGTDFSSYEDSIYRNLYDLADYDLNNKVVDQYLKESIKLWLIKIDGIRVDAVKHMSEGWQTSLMSDIYTYKPVFTFGEWFLGTGEVDPQNHHFANESGMSLLDFQFGQTIRSVLKDRTSNWYDFNEMIKSTEKDYDEVIDQVTFIDNHDMSRFSMVVFNFQTDIALAVLLTSRGVPTIYYGTEQYLTGGNDPDNRKPMKTFDRSTNSYKITSKLASLRQRNSALGYGNTTERWINSDVYIYERKFGNSIVLTAVNSSNRNQTISNLNTSLPQGNYTDELQQLLDGNTITVNANGSANSPQLQANSVAVWQVTKESTSPLIGHVGPMIGKTGNTVTVSGEGFGDKKGSVLFGSTSAEIVSWSNTEIQVKVPNVTAGHYNLSVVNATNTKSPAYEKFEVLSGNQVSVRFAVNNATTNSGTNVYIVGNVSELGNWDPNKAIGPMFNQVMYKYPTWYYDISVPAGKNLEYKYIKKDHNGNVTWQSGNNRTYTSPATGTDTVISNW

SEQ ID NO: 12487 - protein, 125 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 12488 - protein, 454 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDKDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEA

SEQ ID NO: 12489 - protein, 206 aa, Zea mays
  unsure (1)..(206): unsure at all Xaa locations
MDLSAVHAALSAKSYSAIATLCDDLFLQVASRGVATDDWPYAVHLLGHLYLNDLNSARFLWKTVPQEVKDAHPELGAIWKIGQCLWNRDYAGVYTSAQGFEWGPEISDFVTAFLESYRKRIFELLTSAYTTISIADVAHFMGMSEEDATNYAVQNGWXSLDVATKMLTVRKQKPQTNQKLDASKLQRCPEMCFPXRHLMPPPPPPP

SEQ ID NO: 12490 - protein, 400 aa, Zea mays
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHIPPGENALSDVLLSTPIFTGEEGGSGFAASAAAAAATGASGFEFGVDPNVDPELALALRLSMEEERARQEAIAKKAAEDTSNTEHNNVPSSNSDSVMAEGEPASNAAAGDKEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDTSDKTEDDKN

SEQ ID NO: 12491 - protein, 467 aa, Oryza sativa
MRERSFSSPPYYLLLENSSKQKRDQGIKGFLYRSLEERSFLSAGIQGIAGVLFSCAKSVTSMRRVRVSSHQSPVHKLGDSQMKLTPKFRLATTSALPSSMPASDLEQASWETPLIPGLPDDAALNCLLRLPVETHEACRLVCRRWHHLLADKARFFMQRKVMGFRSPLLFTLAFHRCTGKIQWKVLDLNYLTWHTIPAMPCRDRACPRGFGCVAIPSDGTLLVCGGLVSDMDCPLHLVLKYDVYKNRWTVMTRMLAARSFFAGGVIDGRVYVAGGYSTDQFELNSAEVLDPVKGVWQPVASMGMNMASSDSAVISGRLYVTEGCAWPFFSSPRGQVYDPKIDRWEVMPVGMREGWTGLSVVIDKHLFVISEYERMKVKVYDPETDSWDSVKGPPMPERIMKPFSVSCLENKIVVVGRGLHVAIGHVKKQPGSHPDSRSSSYLIQWQDVDVPREFGDLTPSNSQILYA

SEQ ID NO: 12492 - protein, 533 aa, Triglochin maritimum
LITILPSVLPNIHSSATLFLLLLMTTALSFLFLFKQHLAKLTKPKSTTLPPGPRPWPIVGSLVSMYMNRPSFRWILAQMEGRRIGCIRLGGVHVVPVNCPEIAREFLKVHDSDFASRPVTVVTRYSSRGFRSIAVVPLGEQWKKMRRVVASEIINAKRLQWQLGLRTEEADNIVRYITYQCNTSGDTSGAIIDVRFALRHYCANVIRRMLFGKRYFGSGGVGGGPGKEEIEHVDATFDVLGLIYAFNAADYVSWLKFLDLHGQEKKVKKAIDVVNKYHDSVIDARTERKVEDKDPEDLLDVLFSLKDSNGKPLLDVEEIKAQIADLTYATVDNPSNAVEWALAEMLNNPAILQKATDELDQVVGRHRLVQESDFPNLPYIRACAREALRLHPVAAFNLPHVSLRDTHVAGFFIPKGSHVLLSRVGLGRNPKVWDNPLQFNPDRHLHGGPTAKVELAEPELRFVSFTTGRRGCMGGLLGTAMTYMLLARFVQGFTWGLHPAVEKVELQEEKCSMFLGEPLRAFAKPRLELLQSF

SEQ ID NO: 12493 - protein, 92 aa, Eremothecium gossypii
MSDEQEQKPEIKPETHINLKVSDGSSEIFFKIKRTTPLRRLMEAFAKRQGKEMDSLRFLYDGVRIQPDQTPDDLDMEDNDIIEAHREQIGGS

SEQ ID NO: 12494 - protein, 468 aa, Pseudomonas syringae pv. syringae B728a
MSKSVQLIKDHDVKWIDLRFTDTKGKQQHVTMPARDALEDDFFEVGKMFDGSSIAGWKGIEASDMILLPDDETALLDPFTEEPTLVLVCDVIEPSTMQGYDRDPRAIAHRAEEYLKSTGIGDTVFVGPEPEFFIFDEVKFKSDISGSMFKIFSEQASWMTDGDVDGGNKGHRPGVKGGYFPLPPVDHDHEIRTAMCNALEEMGQTVEVHHHEVATAGQNEIGVKFNTLVKKADEVQTLKYCVHNVADAYGRTATFMPKPLYGDNGSGMHVHMSISKDGKNTFAGEGYAGLSDTALYFIGGIIKHGKALNGFTNPSTNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIELKSEEEIKVRTFVHPLEYELYYSC

SEQ ID NO: 12495 - protein, 228 aa, Microbulbifer degradans 2-40
MSIPQAKRDFKIAPSILSADFARLGEEVDAVLKAGADFVHFDVMDNHYVPNLTFGPMVCKALRNYGITAPIDVHLMVDPVDDLVKTFADAGATYISFHPDASRHADRTVKLIRDLGCKPGVVLNPAVTLESVKHLLDQVDMLLLMSVNPGFGGQKFIPYTLDKLKEARARLDDAGLEARLEVDGGVSTANIADVARAGADTFVAGSAIFGAQNYESVIKQMRDTLAQL

SEQ ID NO: 12496 - protein, 149 aa, Glycine max
MPKIMWKSLHLCFPSNLTKCYSSPCLPPLAAAAAEDDDPSRPSIVLINNFNLLYHNDHNNYHHRVVDLPSSSTATTFSSSATSSYESESQDISPELSAAFASRRFFFSSPGRSNAITDSPETRSRELSDNSDSATTKTPKKTKYDTSMN

SEQ ID NO: 12497 - protein, 158 aa, Glycine max
MGRGRVELKRIENKINRQVTFAKRRNGLLKKAYELSVLCDAEVALIIFSSRGKQYEFCSSSSMLRTLDRYQKCNYGAPEPNVPSREALAELNSQQEYLKLKERYDALQRTQRNLLGEDLGPLSTKELESLERQLDSSLKQIRALRTQFMLDQLNDLQS

SEQ ID NO: 12498 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGRPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 12499 - protein, 333 aa, Zea mays
MGQQEGHSNPHPDEAALPTTTAAPSPSPSSSRLYTAWLVASWYASNIGVLLLNKYLLSVYGFRFPLLLTACHMSACAVLSTLAQHASPRPRSSSSPRSHRQLARVALLGAVFCASVVAGNVSLRHLPVSFNQAVGATTPFFTALLAYAVAARREACATYAALVPVVAGVAIATGGEPSFHLFGFVMCVAATVGRALKTVLQGILLSSEEEKMDSMDLLRYMAPVAVLLLVPATLAMERDAFGVVAGLAREDPSFLWLLLCNSCLAYFVNLTNFLVTKHTSPLTLQVLGNAKGAVAVVVSILIFRNPVTVVGMLGYGVTVAGVVLYGEAKKRSK

SEQ ID NO: 12500 - protein, 665 aa, Oryza sativa
MGVATVTELRQSFSGKRALRPTLTSRHANEWPPTDVSSDLTVEVGTSSFALHKLLAQFPLVSRSGKIRRAVAEAKDGKLARLGLHGTPGGAAAFELAAKFCYGVGVDVTVGNVAMLRCAAHYLQMTEDFSDKNLELRAEAFLRDAVLPSIAGSVAVLRSCEALLPAAEDVNLVPRLIAAIANNVCKEQLTSGLSKLDQLKPPPPPQAVVVAAAAAGDLDSPGDWWGKSVAGLGLDFFQRLLSAVKSKGLKQETVTRILINYAQNSLHGLMARDIAAAAKCGGGGGDTDAVKKQRAVVETIVGLLPAQSKKSPVPMAFLSGLLKTAMAASASSICRADLEKRIGMQLDQAILEDILVAAGPVSAAAAAAAVEHTLYDTDVVARIFAVFLNLDDDSNDEDAVVVGGGCGAFDYDSPRSPKQSLLVKASKLLDSYLAEIALDSNLLPSKFISLAELLPDHARLVTDGLYRAVHPNIKEAERYRMCKAIDCQRLTPDACSHAAQNERLPVQMAVQVLYFEQLRLRSAIQATGTTTTTTNTSIGGAHDAALFFGCAAAAAAPRSGSGVGSGAMSPRDSYASVRRENRELKLEVARMRMRLTDLEKDQVSMRRELVRVGPANRLLRGLARRLGSLFHFRGAAAEPGLQQLGAKATADAKVLFQRRRRHSIS

SEQ ID NO: 12501 - protein, 374 aa, Sulfolobus acidocaldarius
MSAQVMLEEMARKYAINAVKADKEGNAEEAITNYKKAIEVLAQLVSLYRDGSTAAIYEQMINEYKRRIEVLKELIPADGAGNGNGKHSQVSVDDLVMKEKPKVNFNDIVGLEDVKEALKEAIVYPTRRPDLFPLGWPRGILVYGPPGCGKTMIAAAVANEIDSYFIQVDAASVMSKWLGEAEKNVAKIFNSARELSKKDGKPVIIFIDEIDALLGTYNSENGGEVRVRNQFLKEMDGLQDKSENFKVYVIGATNKPWRLDEPFLRRFQKRIYIRLPDIEQRKSLLLHYTSKIKMDNVNIDELAKMTEGYTASDIKDIVQAAHIRVVKEMFDKKLEQPRAVNMEDFKEILKIRKPSVNSEVIKVYEAWHEKYKAL

SEQ ID NO: 12502 - protein, 318 aa, Corynebacterium glutamicum ATCC 13032
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 12503 - protein, 154 aa, Triticum aestivum
  unsure (1)..(154): unsure at all Xaa locations
MAPTVMASSATSVAPFQGLKSTAGLPVSRRSNGASLGSVSNGGRIRCMQVWPIEGIKXFETLSYLPPLSTEASSSRSDYXIRSKWVPCLRFNKVGSSPVEHNHLLGYXNGRIGHXELPIFXXNDXQSDNEVEEVKKDTLPYFRSGTNASRHQTL

SEQ ID NO: 12504 - protein, 430 aa, Physcomitrella patens
  unsure (1)..(430): unsure at all Xaa locations
LEGRPTPRSSAALGSSSLRASSTSRGHVSVSTSGVCAQKKNVSFSAEDSFAGSVKSLRVAASPVSRSISRSFTVRATATEFPVRTTKSGSQEKIRIGINGCGRIGRLVLRVILARDDVEVVAVNDPFIDTKYMAYLLKYDSTHGLLKSEVNAVDDNTLQVGSQTIKVFGCRDPAEIPWGSVGADFVVESTGVFTAVDKASAHFKGGAKKVVISAPSXDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLKKSGSYEDIKAAIKAASEGPMYGILGYTEDDVVSNDFVGDARSSIFDAKAGIALSDKFVKLVSWYDNEWGYSNRVVDLDLHMAGVKANLY

SEQ ID NO: 12505 - protein, 302 aa, Zea mays
MAGMSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMALLNGGVFGVILLLTLLLFKGSKRVVLLGWICVGFSVSVFVAPLSIMRRVIQTKSVEYMPFSLSLSLTLSAVVWFLYGLLIKDKYVALPNVLGFIFGVVQMVLYVFYMNKTPVAATAVGKDAGKLPSAADEHVLVNIAKLNPALPERTSGMHPVTQMAAVPARSCAAEAIAPAMLPNRDVVDVFVSRHSPAVHVV

SEQ ID NO: 12506 - protein, 408 aa, Kluyveromyces lactis
MLSLKAQSSVVGKSSSLRLVRNFSKNVRALSQVADETKPGDDDLVQIDLPETSFEGYLLDVPELSYQTTKSNLLQMYKDMIIVRRMEMACDALYKAKKIRGFCHSSVGQEAIAVGIENAITKRDTVITSYRCHGFTYMRGAAVQAVLAELMGRRTGVSFGKGGSMHLYAPGFYGGNGIVGAQVPLGAGLAFAHQYKHEDACSFALYGDGASNQGQVFESFNMAKLWNLPAVFCCENNKYGMGTAAARSSAMTEYFKRGQYIPGLKVNGMDILAVTKLKDWTVSGNGPIVLEYETYRYGGHSMSDPGTTYRTRDEIQHMRSKNDPIAGLKMHLLELGIATEDEIKAYDKAARKYVDEQVELADAAPAPEAKMSILFEDVYVPGSETPTLRGRLQEDTWDFAKKSFAFRD

SEQ ID NO: 12507 - protein, 371 aa, Dendrobium sp. XMW-2002-2
MWRHSCCYKQKLRKGLWSPEEDEKLLKHITKYGHGCWSSVPKLAGLQRCGKSCRLRWINYLRPDLKRGTFSQQEENLIIELHGVLGNRWSQIAAQLPGRTDNEIKNLWNSCIKKKLRLRGIDPNTHKPLAETEVQLAEIDSADQPAPEPEKHTVQQTETGVPNNSVRPGNSPAASYFSLPDLTYSPDCGGSIGQIQQFWLNQSGKFFSNNNSNSEFSFNSVSSLVPSVPRSTLSTSKELKPLTSLLMENSPSGFYWETGNSSNSSASSGSNDPLFDGSIFQWTQLIPERDINVQLHGETEDLKWSEYLNGSIPLSTELQSQNPELCNGMKAEEQFGIDGLSIWLQNHQQQQQQQQQASNNYGKDSQRDIIC

SEQ ID NO: 12508 - protein, 135 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEA

SEQ ID NO: 12509 - protein, 504 aa, Zea mays
  unsure (1)..(504): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLXRDPRGFXAVKFYTREGNXFDLVGNNMAXFFIRDGMKXFPDMVHAFQAXPKTNLQENWRIVDFFSHHXGSLHMFTFLXFDDVGIPLNYRHMGGALGVNTYTLXINRDGKASTLVKFHWEALLVGVKCLLDNEAVDWVEAPGHSHGXTRDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAXHNNHHDGFMNFMHRDEEVNYFPXSRFDPARHAEKVPIPPRVLTGCREKCIIQKENNFKQAGERYRSFDPARQDRFIQRWVDALTDPRVTHEHRTIWISYWSQCDXXLAQKLASRLNLKPSM

SEQ ID NO: 12510 - protein, 506 aa, Zea mays
MVSGQKGTGFSVPVAVVTPLSAPAEEGCARRETREGEGRRRGGVVVKSMPPPSPLLRSSAFVVLLLLVCRLLVVANGRATPPSPGWPPAAQPALQPAPTASGGVASVLASAVAPPPLGVVVAERHHHLSRELVAAIILSSVASVVIAIAALYAFLLWRRSRRSLVDSKDTQSIDTARIAFAPMLNSFGSYKATKKSAAAMMDYTSLEAATENFSESNVLGVGGFGSVYKANFDGRFAAAVKRLDGGAHDCEKEFENELDLLGKIRHPNIVSLVGFCIHEENRFVVYELMESGSLDSQLHGPSHGSALSWHIRMKIALDTARGLEYLHEHCNPPVIHRDLKSSNILLDSDFSAKISDFGLAVTSGNHSKGNLKLSGTMGYVAPEYLLDGKLTEKSDVYAFGVVLLELLLGRKPAEKMAQSQCRSIVTWAMPQLTDRSKLPNIIDPMIKNTMDLKHLYQVAAVAVLCVQPEPSYRPLITDVLHSLVPLVPTELGGTLRIGPESPYLRY

SEQ ID NO: 12511 - protein, 334 aa, Triticum aestivum
EEEEGCATWHGIHGIVGSFFFLFLPLPLALPSSQAPVSPPSQPAAAERGPGGRHRRLLSATPLRPETGEMEGFEFFQIILDNSSSRLRLPDKFTRVLLDGGKPQEVKLQEAGHGRRFWDVKVVLDADGHMYLGRGWEQFARAHDLRLGYFLVFSFDGDAVLTVKVFDVSMCRRHYQHDGDTSSGSSSDGDSGSSNASDGGSGGNNWSLAEMDVEDGPTGQFSAMLRKCNLGMKQEQYLNVPVDFQLAHGYAERSKVELRMRGKSWLVHLKHNPKTGGRPRASFRYGWHQFCVDNALGEGDTCFFRALRQGSAGGGGEDHLLKVEVRRRDGSFLV

SEQ ID NO: 12512 - protein, 673 aa, Rhodobacter sphaeroides
MSDAIRPQPGILDIALYEGGKSHVAGIQNALKLSSNENPFGPSPKAKEAFLRSVHTLHRYPSTDHAGLRHAIAEVHGLDPARVICGVGSDEIITFLCQAYAGPHTDVVFTEHGFLMYRISALAVGANPVEVPERERTTDVDAILAACTPHTRLVFLANPNNPTGTMIGQADLARLAAGLPAQAILVLDGAYAEYVPGYDAGLALIEERGNVVMTRTFSKIYGLGGLRVGWGYGPKAIIDVLNRIRGPFNLSTTQLETAEAAVRDQDHVARCRADNARWRIWLAEALAEIGVPSDTSMANFILARFSDTEEAEACDLHLQTQGADRAPRCGLQAAALPAHHHRRRGLVPPRRPCDRPVQEDALMALYERVALIGLGLIASSMAHAIRAAGLATEITGHARSAETRAAAVEIGLCDRVFETAAEAVAGADLVVLAVPVGAMGAIAAEIAPHLAPGATVTDVGSVKQAVITAVAPHVPEGVHFVPGHPLAGTEHSGPRSGFATLFRNRWWLLTPPEGADPEAVARLRALCEGMGANVEEMDAAHHDLVLAVTSHTPHLIAYTMVGVADHLRRVTQSEIIRYSAAGFRDFTRIAASDPTMWRDVFLTNKEATLDILGRFTEELFALQRAIRLGDGDHLFEYFTRTRAIRRGIIEAGQDTAAPDFGRAAEAGKGTEKG

SEQ ID NO: 12513 - protein, 242 aa, Bacillus subtilis
MPYLKRVLLLLVTGLFMSLFAVTATASAQTGGSFFDPFNGYNSGFWQKADGYSNGNMFNCTWRANNVSMTSLGEMRLALTSPAYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTLGKIMMNLWNGTGVDEWLGSYNGVNPLYAHYDWVRYTKK

SEQ ID NO: 12514 - protein, 474 aa, Vigna radiata
MVSLPTLLLLFAASAAAIFLHRAFSRRKFRLPPGSYGLPFIGETLQLISAYKSSNPEPFMDERVRRYGSIFMTHVFGEPTVFSADPELNRFILQNEGKLLDCSYPGSISNLLGKHSLLLMKGALHKRMHSLTMSFANSSIIKDHLLHHIDRLIGLNLDTWSDRVTLMDQAKKITFELTVKQLMSFDPDEWTESLRKEYVLVIEGFFTLPLPLFSTTYRRAIKARTKVAEALTLVVRQRREEYNQGKEKKSDMLGALLASGDHFSDDQIVDFLLALLVAGYETTSTIMTLAVKFLTETPLALAQLKEEHDQIRARSDPGAPLEWTDYKSMVFTQHVVNETLRVANIIGGIFRRATTDIDIKGYTIPKGWKVFASFRAVHLNPEYYKDARTFNPWRWQSNSSEAANPANVYTPFGGGPRLCPGYELARVVLSVFLHRIVTRFSWVPAEEDKLVFFPTTRTQKRYPIIVKRRNANHV

SEQ ID NO: 12515 - protein, 557 aa, Clostridium thermocellum ATCC 27405
MNENNLNMIKVVFPDNSEREVYEGISLQELSESCKNQYKSTIVAAKVNNDIKELSYRLNESCRVEFIDLTDDDGMRIYKRSLSFILIKAVNDLFPDRKVIICHSISKGIYCEVKGDTPLTVEEVDMIKNRMKEIVNLKIPFIKKIMSLDEAREVFRKIGRMDRFRSIEYRKKPYVTLYECDGFQDYFYGYMVPHTGYLDKFDLKYYQPGLILMSPEKTSPDAIPQFKEQKKLFSIFAEYKKWGKILGVEDVSALNDIVKEGKINELIRVAEALHEKKIAQIADMIAFNEHKKKVVLIAGPSSSGKTTFAHRLSIQLKVNGLRPVTISLDDYFVDRELTPKDENGEYDFEALEAIDIKLFNRHLAELIEGKEVDVPIFNFPKGCRESFCRKLKIDEDQIIIIEGIHGLNEKLTASIPKENKFKIYVSALTSMNIDEHNRIPTTDTRIIRRIVRDYQFRGCSAANTIKRWPSVRRGEERNIFPFQEEADVMFNSALMFELGVLKTYAEPLLMEIDSSEPEYSEARRLIEFLNNFLPIDSKEIPANSIIREFIGGSCFYQ

SEQ ID NO: 12516 - protein, 501 aa, Solanum chacoense
MQLISIFLFICFLFLLRKWKKYSKNSQTKKLPPGPWKLPFIGSMHHLAGGRPHRVLRDLAKKYGPLMHLQLGEVSAVVVTSPDMAKEVLKTHDIAFASRPKLLAMDIICYDRCDIAFSPYGEYWKQMRKICVTEVLSAKSVRSFSSIRCDEVVRLIDSIQSSSSSGELVNFKERVIWFTSSMTCRSAFGQLPKEQDMFIKLIREVIRLAEGFDVADIFPSYKFLHVFGRAKRKLLNVHRKVDAIVEDVINEHKKNFATRKNDDHALGGENLIDVLLKLMNDKSLQFPINNDNIKAIIIDMFAAGTETSSTTTVWAMVEMLKNPRVLAKAQAEVREAFRNKVTFDENDVEDLKYLKLVIKETMRLHAPIPLLVPRECRKETEINGYTIPVKTKVMVNVWALGRDPKYWDDVECFKPERFEQCSIDFIGNNFEYLPFGGGRRICPGTSFGLANDYLPLAQLLCHFDWKLPTGMEPKDLDLTELAGMSAASKDDLYLIATPYQP

SEQ ID NO: 12517 - protein, 367 aa, Liquidambar styraciflua
MGSTSETKMSPSEAAAAEEEAFVFAMQLTSASVLPMVLKSAIELDVLEIMAKAGPGAHISTSDIASKLPTKNPDAAVMLDRMLRLLASYSVLTCSLRTLPDGKIERLYGLAPVCKFLTRNDDGVSIAALSLMNQDKVLMESWYHLTEAVLEGGIPFNKAYGMTAFEYHGTDPRFNTVFNNGMSNHSTITMKKILETYKGFEGLGSVVDVGGGTGAHLNMIIAKYPMIKGINFDLPHVIEEAPSYPGVEHVGGDMFVSVPKGDAIFMKWICHDWSDEHCLKFLKKCYEALPTNGKVILAECILPVAPDASLPTKAVVHIDVIMLAHNPGGKERTEKEFEALAKGAGFEGFRVALCAYNTWIIEFLKKI

SEQ ID NO: 12518 - protein, 356 aa, Oryza sativa (japonica cultivar-group)
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 12519 - protein, 225 aa, Oryza sativa (japonica cultivar-group)
MDHWKHNFMGPSHGSALSWHIRMKIALDTARGLEYLHEHCNPPVIHRDLKSSNILLDSDFNAKISDFGLAVNHWESPPKEILKPFWGHWGLCSSPSTWKLTEKSDVYAFGVVLLELLLGRRPVEKTAQSQCQSIVTWVPNILPQLTDRSKLPNIIDPMIKNTMDLKHLYQQVAAVAVLCVQPEPSYRPLITDVLHSLIPLVPMELGGTLRISPESPCATRKQSPC

SEQ ID NO: 12520 - protein, 137 aa, Triticum aestivum
SAEAALVELLLDEPERRVCELALPVLDRLCTCAEGRAELVAHAAGVAVVGKKVLRVSDAASERAVRVLRSVARHAATPAVLQEMAHAGVVGKLCLALRSELCGVKTKEKAHEVLKLHSRIWRSSPCLSPKFLALYPS

SEQ ID NO: 12521 - protein, 520 aa, Zea mays
MGEAQDYYNTSTALAGAAAAGLALLAVCSYYLLVGRRRGKAPKRYAPVVGTVFHQLYHVRRLHDYHTDLFRQRKTFQLLVPAGRRQIYTCDPAVVEHILRTNFANYGKGSFNYENMTDLLGDGIFAVDGDKWRQQRKIASYDFSTRALRDFSGAVFKRNAARLAGIVSGNAASGQPMEFQGLALRATMDSIFTIAFGLDLDTLGGSAEGSRFAAAFDDASEFTLLRYVNAFWKAQRFLGVGSEAALKKRVKVVDEFVYKRIRERAQELSDSKMATEDTVPDSRQDMLSRFIHTATNESGTVDYKYLRDIILNIVIAGKDTTAGALAWFLYMACKHPEIQEKICQEAAKATSASETAGVDEFAQSLTDEALNKMHYLHAALTETLRLYPSVPLDNKQCFGDDVLPDGSSVSKGDIVFYVPYAMGRMEYLWGKDAEVFRPERWLDQDGEFQQESPFKFTAFQAGPRICLGKEFAYRQMKIFAAVLLRFFVFRLRDGDKASVNYRTMITLHIDEGLHLTATAR

SEQ ID NO: 12522 - protein, 404 aa, Haemophilus influenzae Rd
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 12523 - protein, 398 aa, Zea mays
MKGGGVIRAAGGGAGGAGLLRTRLRLPVVLLSCSLFFLAGFFGSLLFTQDPEEADMPVPRERLLEAAWPEMPYGESGEAAPSLIPYQVMSHSDSISAWGGCLFRHTFGVTGIEFAGQLSAYNFHGLLVLRVGNFVWHFKISRHPDSRGKCRRCGCCGTFSQPHQSQLYICFCHHLPNVVQQIIGYIEDNFLILSWQPRALYFPQFATSEQCENIVKTAKERLKPSTLALRKGETAESTKGIRTSSGTFLSANEDPTETLAEIEKKIARATMLPRNHGEPFNVLRYNIGQRYASHYDAFDPAQYGPQKNQRVASFLLYLTDVEEGGETMFPYENSENMDIGYDYEKCIGLKVKPRKGDGLLFYSLMVNGTIDRTSLHGSCPVIKGEKWVATKWIRDNIV

SEQ ID NO: 12524 - protein, 664 aa, Azotobacter vinelandii
MICSHMERSSLLVPASIDSHSRESETTGLDQAIVRARAALLGRQGADGHWCFELESDCTITAEYILMMHFTDEIDEDLQERMARYLRATQVQETHGGWPQYVGGAIDLSCTVKAYYALKAAGDSPEAPHMRRAREAVLALGGAAKSNVFTRILLAMFEQVPWRAVPYLPVEIMLLPRWAPIHIEKMSYWARTTLVPLTILCSLKARAANPKRVDIRELFVTAPEQERHYFLRGGLLNRIFLGLDKFARTLDRWMPKSLRQHAIRKAEAWFLPRMNGEDGLGAIFPPMVNCYEAMILLGYPKDHPARKTCLRSIQKLIVHRDDGSAYCQPCVSPVWDTAWSAMALIHSGDDTATQTAIARAGDWLVQRQELDCRGDWEAQAPQAAPGGWAFQYANGYYPDIDDTALVAALLHISDRRRGQPGQHAFNIDRAVDWMLALQSRNGGFAAFDADNTHYYLNAIPFADHGALLDPPTEDVSGRVAACLGILKRDQDRDGLRRCIDYLRTTQQPDGSWWGRWGSNYIYGTWSALSGLALAGEDLRQPYLRKSVDWLRTRQHPDGGWGETNDSYIDPHLAGTNAGISTPHSTAWAVLAQLAMGEVESDSVRRGIAFLLACQQTDGLWSHPSHNAPGFPRVYYLKYHGYAAYFPLYALARYRHLLNRSREQR

SEQ ID NO: 12525 - protein, 415 aa, Polysiphonia denudata
EASAAVAGESSAATWTVVWTDLLTACDLYRAKAYKVDAVPNTSDQYFAYIAYDIDLFEEGSIANLTASIIGNGIRFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEEMYERAEFGKQIGTVIIMIDLVIGYTAIQTMAIWARKNDMILHLHRAGNSTYSRQKIHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITF

SEQ ID NO: 12526 - protein, 355 aa, Blumeria graminis
MSTRAPNATTGSRKISFNVSEQYDIQDVVGEGAYGVVCSALHKPTGQKVAIKKITPFDHSMFCLRTLREMKLLRYFNHENIISILDIQKPRSFDSFTEVYLIQELMETDMHRVIRTQDLSDDHCQYFIYQTLRALKAMHSANVLHRDLKPSNLLINANCDLKVCDFGLARSAASQEDCSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKQMFPKTSDLALDLLEKLLAFNPVKRITVDEALQHPYLEPYHDPEDEPTADPIPEEFFDFDKNKDNLSKEQLKELIFQEIMR

SEQ ID NO: 12527 - protein, 302 aa, Pseudomonas syringae pv. syringae B728a
MQDLLNEILDEVRPLLGQGKVADYIPALGEVRPDQLGIAVYGNDGQVFSAGDAETAFSIQSISKVFSLVQAINHSGEEIWQRLGHEPSGQPFNSLVQLEFEQGRPRNPFINAGALVICDINQARFAAPSLSMRDFVRRLCGNRAITSDSKVADSEYQHRSRNAAAAYLMKSFDNFHGDVEDVLRSYFHHCALSMNCIDLAKAFGFLAHQGFCAHSGEQVLTARQATQVNSIMATSGLYDEAGNFAYRVGLPGKSGVGGGIVAIVPERASVCVWSPELNAAGNSLVGMAALEKLSARVDWSVF

SEQ ID NO: 12528 - protein, 242 aa, Panax ginseng
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 12529 - protein, 362 aa, Saccharomyces cerevisiae
MSRKFDLKTITDLSVLVGTGISLYYLVSRLLNDVESGPLSGKSRESKAKQSLQWEKLVKRSPALAEVTLDAYERTILSSIVTPDEINITFQDIGGLDPLISDLHESVIYPLMMPEVYSNSPLLQAPSGVLLYGPPGCGKTMLAKALAKESGANFISIRMSSIMDKWYGESNKIVDAMFSLANKLQPCIIFIDEIDSFLRERSSTDHEVTATLKAEFMTLWDGLLNNGRVMIIGATNRINDIDDAFLRRLPKRFLVSLPGSDQRYKILSVLLKDTKLDEDEFDLQLIADNTKGFSGSDLKELCREAALDAAKEYIKQKRQLIDSGTIDVNDTSSLKIRPLKTKDFTKKLRMDATSTLSSQPLD

SEQ ID NO: 12530 - protein, 331 aa, Rhizobium sp. NGR234
MKTLLLKKDEVRRLIGMPEVIGAVEEAYKAFNSDQVEQPDYIGIDLPSPRGEIDFKLGYYKANEVISMKASSGGFVDNPTAHGVPNGMATIFLFDGRSGALICVMDGSLILGLRTGASGAVSVKALARKNASTIASIGTGNQARMQIRAINEIMKIEEIHAWDRHPDTLAKYKTDIESEFGIPVIVANSKKEAVEQADILITTTRGKGSLVEADWVKPGTHIVAIGTDQRGKQELDPEIFRNAKVVVDSIAQCAEKGETWHPLNKNIITRNAIHGEIGEILLGRKPGRERDDEITIFDSTGMAIQDNTTAGKIYQNAIANNVGTFFQFFEE

SEQ ID NO: 12531 - protein, 331 aa, Rhizobium sp. NGR234
MPTMKILTEGELRQIVPLDLDAVKCTEDAFRALAVPNAVKMPPILRLDVPDSRGEVDVKTAYIPGLGGFAIKISPGFFDNPKIGLPSTNGMMVLLSSQTGLVQALLLDNGYLTDVRTAAAGAVAAKHLSQQDASVATIFGAGVQARLQLRALTLVRPIRQARIWARDQLKAEALVEQLKLEHSFAISASDDPRQAVSGAHIVVTTTPADRPILVASWLEAGQHVTAMGSDAEHKNELDPAAIARADVYVADSLTQTRRLGELHHAIEAGLIARDAAFPELGEVIAGVKTGRTRESDITIADLTGTGVQDTAIATLAFQRAEERSAGSLFES

SEQ ID NO: 12532 - protein, 345 aa, Glycine max
MAFHDHLQHEIAFQRFTEEQELTENRDMQQRLPPPTWLNNVNARQQNFLDTEKSVDRNNRSESNCESEDLREYKADILGHPLYDQLLSAHVSCLRIATPVDQLPRIDAQLQQSQRVVEKYSALAHNGVVDEKELDQFMTHYVLLLCAFKEQLQQHVRVHAMEAVMACWDLEQSLQSLTGVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKSSAGEASNQSFM

SEQ ID NO: 12533 - protein, 159 aa, Buchnera aphidicola
MANILLLDNIDSFTYNLVDQLRKHKNNVVVYRNTVDIKIISHALIQLTNPILMLSPGPGLPRDAGCMSSLIKIVKGQIPMIGICLGHQAIVEAYGGQIRYAGEIFHGKVSSISHDGLEMFKNVPQYLPVARYHSLICSNVPKDFVINASFNQMIMSVRH

SEQ ID NO: 12534 - protein, 341 aa, Zea mays
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 12535 - protein, 392 aa, Trichodesmium erythraeum IMS101
MYSINPAKRVQALPPYVFARLDELKARAREQGLDLIDLGMGNPDGATPKPVVEAAIAALQDSTNHGYPPFEGTASFRKAITDWYFRRYSVKLDPDGEALPLLGSKEGLTHLALAYINPGNLVLAPNPAYPAHFRGPLIAGGKVHSILLKPENDWIIDLADIPDSVAEQAKVFYFNYPSNPTGATAPREFFQDIVTFAKKYEILLVHDLCYAELAFDGYQPTSLLQIPGGKDIGVEFHTMSKTYNMAGWRIGFVVGNSNVIQGLRTLKTNMDYGVFSALQLAAKTALQLPDEYLSQVQERYRQRRDFLIQGLGKLGWNVQKTMATMYLWVPCPPGIGSTDFALSVLQKTGVVVTPGNAFGSGGEGYVRISLIAECKRLDEALNRFKKAGIYYQ

SEQ ID NO: 12536 - protein, 512 aa, Mesembryanthemum crystallinum
MFIESFKVESPNVKYTENEIESVYNYDTTELVHENRKDAGGYQWIVKPKTVQYHFKTDTRVPKLGVMLVGWGGNNGSTLTGGVIANREGISWATKDKIQQANYFGSLTQASSIRVGSFNGEEIYAPFKSLLPMVNPDDVVFGGWDISDMNLADAMTRARVFDIDLQKQLRPYMEHMVPLPGIYDPDFIAANQGSRANNVIKGTKKEQVERVIKDIREFKEKNKVDKVVVLWTGNTERYSNVVVGLNDTMENLLASLEKNESEISPSTSYALACIEENIPFINGSPQNTFVPGLIDLAIKKNSLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGTNTIVMHNTCEDSLLAAPIILDLVLLAELSTRIQLKAEEEDKFHSFHPVATILSYLTKAPLVPPGTPVVNALSKQRAMLENILRACVGLAPENNMILEYK

SEQ ID NO: 12537 - protein, 606 aa, Lotus corniculatus
MDVKLGSLDTTKPASNDVVSCATANHTTAIQSSIPSTAVSSCDATLGRHLARRLAQIGVTDVFSVPGDFNLTLLDHLIAEPQLNLVGCCNELNAGYAADGYARARGVGACVVTFTVGGLSVLNAIAGAYSENLPLICIVGGPNSNDYGTSRILHHTIGLPDFTQELRCFQTVTCFQAVVNNLEDAHEQIDTAISTALKESKPVYISIGCNLPGIPHPTFSRDPVPFSLSAKLSNQMGLEAAVEATAEFLNKAVKPVLVGGPKLRVAKASDAFVELADASGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNAAYENYHRIFVPEGKPLKSAPKEPLRVNVMFQHIQKMLSGETAVIAETGDSWFNCQKLKLPRGCGYEFQMQYGSIGWSVGATLGYAQAVPEKRVIACIGDGSFQVTAQDVSTMLRCGQNTIIFLINNGGYTIEVEIHDGPYNVIKNWNYTGLIEAIHNGEGKCWTSKVFCEEELVEAIATATGPKKDCLCFIEVIVHKDDTSKELLEWGSRVSAANGRPPNPQ

SEQ ID NO: 12538 - protein, 492 aa, Prunus persica
MDPYKHRPSSAFDSPYWTTNAGAPVWNNDSSLTVGPRGPVLLEDYHLVEKLATFDRERIPERVVHARGASAKGFFEVTHDISQLTCADFLRAPGVQTPVIVRFSTVIHERGSPETLRDPRGFAVKFYTREGNFDLVGNNFPVFFVRDAMKFPDAIRAFKPNPKSHIQETWRILDFFSHLPESLHTFAFFYDDLGVPQDYRHMEGSSVHAYTLISKAGKVHYVKFHWKPTCGVKCLLEDEAIKVGGANHSHATKDLYDSIAAGNYPEWKLYIQTMDPDHEDRFDFDPLDLTKTWPEDILPLQPVGRLVLNKNIDNFFAENEQLAFNPAHVVPGIYYSDDKVLQTRIFAYSDTQRHRLGPNYLQLPVNAPKCPHHNNHHEGFMNFMHRDEEVNYFPSRHDPVRHAERYPIPSNILSGKREKCVIEKENNFKQPGERYRSWAPDRQERFIRRWVDALSDPRVTHEIRSIWISYWSQADKSLGQKLLSRLNVRPSI

SEQ ID NO: 12539 - protein, 434 aa, Photobacterium profundum
MKFPGQRKSKHYFPVHARDPLLSQTKQEKRLTRTHVVGIDQTLVDIEAYVDDAFLERYELSKGHSLVITDEKAEELYRELKDNNLITHEFAGGTIGNTLHNYSVLADDKSVLLGVMSKDIEIGSYAYRYLCNTSSRMDMNFLQPVVGPIGRCFALMSKDGERTFAINEGRMNQLHPDNIPESIFETAAALVLTAYLVRCKEGDPMPEATMRAIEFAKKYDVPVVLTLGTKFVIEDDPQWWRDFLRDHVTVVAMNEDEAEALTGESDPLIASDKTLEWVDLVLCTAGPVGLYTAGYTEDTAKRETSLPLLPGEIAEFNRYEFSRPMLKAECETPIKAYSHIAPYMGGPERIKNTNGAGDGALSALLHDMSANHYHKENVPNSSKHQQSFLTYSSFSQVCLYANRVSYEVLAQHSPRLSRGLPEREDSLEEAYWER

SEQ ID NO: 12540 - protein, 82 aa, Oryza sativa
  unsure (1)..(82): unsure at all Xaa locations
MAPTVMVYSVTFVAPFQGLKSTVRLPRSRRFTNLGFGNXVSNGGRIMCMQAWPIEGIKKFETLSYLPPLTVEDLLKQTEYLV

SEQ ID NO: 12541 - protein, 435 aa, Spyridia hypnoides
  unsure (1)..(435): unsure at all Xaa locations
ETDVLALFRVTPQPGVDAIEASAAVAGESSTATWTVVWTDLLTACDLYRAKAYKVDAVPNSSEQYFAYIAYDIDLFEEGSIANLTASIIGNVFGFKAVKALRLEDMRIPYAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKELGSVIIMIDLVIGYTAIQSMGIWARKNDMILHLHRAGNSTYSRQKNHGMNFRVICKWMRMAGVDHIHAGTVVGKLEGDPKMIQGFYRTLLEPFLEVDLPQGLFFEQDWASLRKVTPVASGGIHCGQMHQLIQYLGNDVVLXXGGGPXRHPNGXXXXXXXXXXXXXSMIIARNEGREYISEGPQILRDAAKTCGPLQTALDLWKDITFN

SEQ ID NO: 12542 - protein, 465 aa, Ptilophora pinnatifida
  unsure (1)..(465): unsure at all Xaa locations
AKMGYWDPDYVIKETDVLALFRITPQPGVDAVEASAAVAGESSTATWTVVWTDLLTACDLYRAKAYRVDPVPKAPDQYFAYISYDIDLFEEGSIANLTASIIGNVFGFKALKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAGTGEVKGHYMNXXXXXXXXMYERAEFAKQLGTVIVMIDLVIGYTAIQTMAIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGEDVVLQFGGGTIGHPDGIQAGATANRVALEAMVIARNEGRNYVEEGPQILRDAAKTCGPLQTALDLWKDITFNYTSTDTADFVETPTANV

SEQ ID NO: 12543 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 12544 - protein, 400 aa, Rhizobium leguminosarum bv. phaseoli
MAFLADALSRVKPSATIAVSQKARELKAKGRDVIGLGAGEPDFDTPDNIKKAAIDAINRGETKYTPVSGIPELRKAIAAKFKRENGLDYSWEQTIVGTGGKQILFNAFMATLNPGDEVSIPAPYWVSYPEMVALCGGTRFFVSATQEHNFKLQAADLEKAITPKTKWFIFNSPSNPTGAAYTHDELKALTDVLMKNPQVWVLTDDMYEHLTYGDFKFVTPVEVEPQLYDRTLTMNGVSKAYAMTGWRIGYAAGPIQLIKAMDMIQGQQTSGATSIAQWAAVEALNGTQDFIPENKKIFEGRRDLVVSMLNQAKGIVCPVPEGAFYVYPSCKGLIGKTAPSGKVIETDEDFVSELLESEGVAVVHGSAFGLGPNFRISYATSEEQLEEACRRIQRFCGACK

SEQ ID NO: 12545 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 12546 - protein, 428 aa, Medicago sativa subsp. X varia
MKFSEEKNVSNNPTNFEGGLDSRKVGQNRRALGVINQNLVVEGRPYPCVVNKRALSERNDVCEKKQADPVHRPITRRFAAKIASTKTSNAEGTTKRSNLAKSSSNGFGDFIFVDDEHKPVEDQPVPMALEQTEPMHSESDQMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 12547 - protein, 354 aa, Agrobacterium sp.
MPALANLNIVPFISVENMMDLAVSTGIENFLVQLAGYIEEDFRRWESFDKIPRIASHSRDGVIELMPTSDGTLYGFKYVNGHPKNTKSGRQTVTAFGVLSDVDSGYPLLLSEMTILTALRTAATSAIAAKYLARKDSRTMALIGNGAQSEFQALAFKALIGVDRIRLYDIDPEATARCSRNLQRFGFQIEACTSAEQAVEGADIITTATADEHNATILSDNMIGPGVHINGVGGDCPGKTEMHRDILLRSDIFVEFPPQTRIEGEIQQLAPDHPVTELWRVMTGQDVGRKSDKQITIFDSVGFAIEDFSALRYVRDRVEGSSHSSPLDLLADPDEPRDLFGMLLRRQAFRRLGG

SEQ ID NO: 12548 - protein, 131 aa, Triticum aestivum
MADHDPELEAIRQRRMQELMGQRGGAASPQNAGQQKAQEDAKQEAEERRQMMLSQILSSEARERLSRIALVKPDKARGVEDVLLRAAQTGGISEKVSEERLISLLEQINSHTSKQTKVTIQRRRYVLDDDD

SEQ ID NO: 12549 - protein, 598 aa, Alcaligenes defragrans
MANDTRQVVQGVQEMTPSEAFVETMVANGVTEIFGIMGSAFMDAMDIFAPAGIKLIPVVHEQGAAHMADGFARVSGRTGVVIGQNGPGISNCVTAIAAAYWAHTPVVIVTPEAGTTGIGLGGFQEARQLPMFQEFTKYQGHVTHPARMAEYTARCFARARDEMGPAQLNIPRDYFYGKIKCEIPLPQPLDRGPGGAQSLDAAARLLAEAKFPVIISGGGVVMGDAVEECKALAERLGAPVVNSYLHNDSFPASHPLWCGPLGYQGSKAAMKLLADADVVLALGTRLGPFGTLPQHGLDYWPKNARIIQVDADSKMLGLVKKITVGVCGDAKASAAEISRRIDGMKLACDANKAERAARIQAEKDAWEQELTDWTHERDPFSLDMIEEQSKEEGNWLHPRQVLRELEKAMPEDVMVSTDIGNINSVANSYLRFEKPRSFFAAMSWGNCGYAFPTIIGAKVAAPHRPAVSYAGDGAWGMSMSEIMTCVRHDIPVTAVVFHNRQWGAEKKNQVDFYNRRFVAGELESESFAGIARAMGAEGVVVDRIEDVGPALKKAIDAQMNDRKTTVIEIMCTRELGDPFRRDALSKPVRLLEKYRDYT

SEQ ID NO: 12550 - protein, 405 aa, Glycine max
MSTTTVSGGDPPSRGFDTPTLDREAAALLHAISEHGGYAYVSMAVLASGGDIRAAEAAREMAWEQLHSGPWHSVLPVWRDAYSMACLHVARHHYGNGEFLDALRVLDLGIIMGGTLLRKDLDSAIEKVSEQTRRSVRVSDLGNSEHRLVDREFDMAEVLQLLPVKSLSTKLVAKKSALSLEKFLKDHYLSGCPVIISDCMAHWPAKMKWNDEDYLLRVAGDRTVPVEVGKNYLCTEWKQELITFSEFLQRIKSDSCSPGGLTYLAQHPLFDQINELRKDIFIPDYCFTGGGELRSLNAWFGPAGTVTPLHHDPHHNILAQVVGKTYIRLYSSSLSEELSPHSGTMLHNSSQVDLDDMDEKKFPKVQDLEFVDCILEEGEMLYIPPKWWHYVRSLTTSFSVSFWWS

SEQ ID NO: 12551 - protein, 250 aa, Zea mays; identical to SEQ ID NO: 984

SEQ ID NO: 12552 - protein, 120 aa, Oryza sativa
MKVKILQWHSVASWTWDAQDETCGICRMAFDGCCPDCKFPGDDCPLIWGSCNHAFHLHCILKWGRKLHLVHVVLSRVQAPGSLATVGKSRVSVTVKLVLQKYHIVLLLADLPFYMAPNFR

SEQ ID NO: 12553 - protein, 458 aa, Arthrobacter nicotinovorans
MAIATIDPTTGITLKTFDAHTPEEVENRIARAEAAFRSLQNTSFEERARWMHKAADILESEADEVARLIATEMGKTLTTAKYEALKSATGMRHFADHAQRYLSPETPVPASEVNASNLHVQFDPLGVVLAVMPWNYPLWQAVRFAAPALMAGNTGLLKHASNVPQCALYLGDLFARGGFPEGAFQTLLVEGKDVIPLVDDARIRAVTLTGSVAAGSAIAEAAGRNIKRSVLELGGMDVFIVMPSADIEKAAAQAVIARLQNSGQSCIAAKRFYVHEDVYDRFEHLFVTGMAEAVAGDPLDESTSFGPLATERGRQDVHELVRDAREKGAAVQCGGEIPEGEGWYYPATVLTGVTEDMRIYREECFGPVACLYKVSSLQEAIALSNDSDFGLSSSVWTNDETEATEAARSIEAGGVFINGLTASFPAVPFGGLKDSGYGRELSAYGIREFVNIKTVWTS

SEQ ID NO: 12554 - protein, 334 aa, Zea mays
MLAPILSKFNSLKTSRKGVVAMAMIEYPSLEAATGKFSASNVLGVGGFGCVYKAVFDGGVAAAVKRLEAGGPECEKEFENELDLLGRIRHPNIVSLLGFWVREGNHYIVYELMEKGSLDTQLHGASHGSALTWHIRMKIALDMARGLEYLHEHCSPPVIHRDLKSSNILLDSDFNAKISDFGLAVTSGNIDKGSMKLSGTLGYVAPEYLLDGILTEKSDVYAFGVVLLELLMGRKPVEKMSQTQCQSIVTWAMPQLTDRTKLPHIVGPVIRGPMDPKHLYQVAAVAVLCVQPEPSYRPLITDVLHSLVPLVPVELGGTLRVVEPPSPNLKHSPC

SEQ ID NO: 12555 - protein, 758 aa, Taraxacum officinale
MWKLKIAEGGDDEWLTTTNNHVGRQHWQFDPDAGTEEERAEIEKIRLNFKLNRFQFKQSADLLMRTQLRKENPINKIPDAIKLNETEEVTNDAVTTTLKRAISFYSTIQAHDGHWPAESAGPLFFLPPLVIALYVTGAMNDILTPAHQLEIKRYIYNHQNEDGGWGLHIEGHSTIFGSVLSYITLRLLGEEADSVAEDMALVKGRKWILDHGGAVGIPSWGKFWLTILGVYEWGGCNPMPPEFWLMPKFFPIHPGKMLCYCRLVYMPMSYLYGKRFVGKITELVRDLRQELYTDPYDEINWNKARNTCAKEDLYYPHPFVQDMVWGVLHNVVEPVLTSRPISTLREKALKVAMDHVHYEDKSSRYLCIGCVEKVLCLIATWVEDPNGDAYKRHLARIPDYFWVAEDGMKMQSFGCQMWDAAFAIQAIFSSNLTEEYGPTLKKAHEFVKASQVRDNPPGDFSKMYRHTSKGAWTFSIQDHGWQVSDCTAEGLKVSLLYSQMNPKLVGEKVETEHLYDAVNVILSLQSENGGFPAWEPQRAYAWLEKFNPTEFFEDVLIEREYVECTSSAIQGLTLFKKLHPGHRTKEIEHCISRAVKYVEDTQESDGSWYGCWGICYTYGTWFAVDALVACGKNYHNCPALQKACKFLLSKQLPDGGWGESYLSSSNKVYTNLEGNRSNLVHTSWALISLIKAGQAEIDPTPISNGVRLLINSQMEEGDFPQQEITGVFMKNCNLNYSSFRNIFPIWALGEYRRIVQNI

SEQ ID NO: 12556 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 12557 - protein, 471 aa, Pyrus pyrifolia
MAAVATGNVDKLKSDVASLSQISENEKNGFINLVSRYVSGEEAQHVEWSKIQTPTDEVVVPYDGLAPTPEDPEEIKKLLDKLVVLKLNGGLGTTMGCTGPKSVIEVRNGLTFLDLIVIQIENLNNKYGSCVPLLLMNSFNTHDDTQKIVEKYSKSNVQIHTFNQSQYPRLVVEDFSPLPSKGQTGKDGWYPPGHGDVFPSLKNSGKLDLLLSQGKEYVFIANSDNLGAVVDLKILHHLIQKKNEYCMEVTPKTLADVKGGTLISYEGRVQLLEIAQVPDQHVNEFKSIEKFKIFNTNNLWVNLNAIKRLVEADALKMEIIPNPKEVDGVKVLQLETAAGAAIRFFNHAIGINVPRSRFLPVKATSDLLLVQSDLYTLQDGFVTRNSARKNPENPTIELGPEFKKVGSYLSRFKSIPSILELESLKVSGDVWFGAGVVLKGKVTITAKSGVKLEIPDNAVIANKDINGPEDL

SEQ ID NO: 12558 - protein, 387 aa, GIBBERELLA ZEAE PH-1
MHPESESVSYCLGENPYLFGTLASGTSFFLTSVEWPIVEISSLARALRPFRDLIPSRLYILLLATDSRLLVPGELGAMSTTVGAFIAGGIAACGAVTATHPFETVKIRMQLQGELQNKGHQPHHYRGPIHGVSVIVRNEGVRKIYRGIGAAYIYQILLNGCRLGFYDPMRNALAKFIFKDGNAQNLGINMFCGAASGVIGAAAGSPFFLVKTRLQSFSKFRPVGTQHHYTGAWHGFKSIYSTEGIGGLYRGVQAAMIRTAFGSSVQLPTYFFAKRRLVRHFGMEEGPGLHLASSAISGFVVCCVMHPPDTVMSRMYNQNGNLYTSAADCFAKTIRSEGIFALYKGFFPHLARILPHTILTLSLAEQTNKLVRKIEGRILPSRMDMAT

SEQ ID NO: 12559 - protein, 253 aa, Zea mays
MQFALALDTNSGPHQIRSCEGDGIDRLEKLSIGGRKQEKALRNRCFGGRVAATTQCILTSDACPETLVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYL

SEQ ID NO: 12560 - protein, 192 aa, Yersinia pestis CO92
MADILLLDNIDSFTYNLVDQLRSSGHRVVIYRNHIAADNIIERLQQLEQPVLMLSPGPGTPAQAGCMPELLQRLQGQLPMIGICLGHQAIIEAYGGHVGQAGEILHGKASAIEHDGQGMFAGMPNPLPVARYHSLVGSNLPAELTVNARFGEMVMAVRHDAHRVCGYQFHPESILTTHGARLLEQTLAWALA

SEQ ID NO: 12561 - protein, 380 aa, Streptococcus pneumoniae TIGR4
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 12562 - protein, 212 aa, Tropheryma whipplei TW08/27
MFKVLVIDNHDSFIYTLVNYLQQLGVTTSVVRSDNNCHSVESMLGVHDAALISPGPGTPEESGITLSVIRAAYSTSTPLLGVCLGHQALAVAFGGDIGPSGRIMHGKLVTVRPRPSAIFKDLPTAFTATRYNSLTVTKVPQALRVIARADCGEVMALEHRTAPMYGVQFHPESAVSEWGFRILGNWLYISGFNKALGISRDLPIVVYNTRVR

SEQ ID NO: 12563 - protein, 339 aa, Trichodesmium erythraeum IMS101
MIRVAINGFGRIGRNFLRCLLTRTDSQLDLVAVNDTSDPKTNAHLLKYDSMLGTLKDVDISTDENSITVNGKTIKCVSDRNPLNLPWADWGIDLIIESTGVFVTEEGASKHLQAGAKKVLITAPGKGGQIGTFVVGVNHQDYKHEDYNIISNASCTTNCLAPIVKVIHDNFGIIKGTMTTTHSYTGDQRILDASHRDVRRARAAAVNIVPTSTGAAKAVALVIPEMKGKLNGIAMRVPTPNVSVVDLVAQVEKKTFVEQVNEVMEVAAKGPMKGIIEYSDLPLVSIDYRGHDCSSIVDASLTMVMDGDMVKVIAWYDNEWGYSQRVVDLAEVVAQNWAA

SEQ ID NO: 12564 - protein, 870 aa, Cochliobolus heterostrophus
MASLLFLSLSGLAAGAAIQQRDPVPAGYVAPPYYPAPHGGWVSDWAESYRKASLLVSNMTLAEKTNLTAGTGIFMGRCVGNTGSALRVGIPQLCLQDGPLGVRNTDHNTAFPAGITAGATWDKDLIYRRAVAIGEEFRGKGVNIHLGPSVGPLGRKPRGGRNWEGFGSDPVLQAFGGSLSVEGIQSTGVIATIKHLIANEQEMYRMWNIVKPGYSSNVDDRTLHELYLWPFAEGVRSGVGSVMIAYNAVNGSACAQNSYMINGLLKDELGFQGFVMSDWLAQISGVSSTLAGLDMSMPGDRNDIPLVLGNSYWMYEQTRSVLNGSVPVDRVNDAVTRILATYFQMGQDQNYPRPNFDTNTQNAEGPLYPGALISPSGVVNEFVDVQGNHAEVAREVARDAITLLKNQDNILPLAASAPLKIFGTDAEKNPDGINSCADQGCNKGTLGMGWGSGSARYPYMDSPIDGFKARGANYQFFNTDNFPGNSNPSPNDTAIVFVTADSGENYITVEDNPGDRTSANLNLWHNGDRLIQDVAAKYSNVVVVVHTVGVILMNEWHDLPSVKAIVFAHLPGQEAGNSLMQVLYGDVSPSGHLPYTLPNAEDDFGNSVKLVGYQLGQPQDTFTEGLYIDYRHFHKANITPRYAFGHGLSYTTFSFSDATITPVTPLTRTPPARPAKGTTPSYSTAIPPASEAYWPANFNRIWRYLYSWLDKNDADAAAQVGTSPSTYPYPAGYSNEQKPGPAAGGAQGGNPALFDVAYDIAVTVTNTGNRSGKAVAQLYLQFPSESTVDTPILQLRDFAKTSTLAAGASQTLKMRLTRKDLSVWDVVEQNWVVPAVSGDYGVWIGGASDDLHLRCGTATGRCQGDQASPV

SEQ ID NO: 12565 - protein, 536 aa, Sesbania rostrata
MAGELGVLNALDVAKTQWYHFTAIVIAGMGFFTDAYDLFCISLVTKLLGRIYYSDPKAPKPGTLPPNVQAAVTGVALCGTLAGQLFFGWLGDKLGRKKVYGITLILMVVCSLASGLSFGSSAKGVMATLCFFRFWLGFGIGGDYPLSATIMSEYANKKTRGAFIAAVFAMQGFGIMAGGIVALIVSAGFDHKYKVPSYQENPQASLVLPQFDYVWRIVLMFGALPAALTYYWRMKMPETARYTALVAKNAQQAATDMSKVLKVELEVEEEKVQKITEADTNKYGLFSKEFAKRHGLHLVGTTTTWFLLDIAFYSQNLFQKDIFSAIGWIPPAKEMNAIHEVYKIARAQTLIALCSTVPGYWFTVAFIDYMGRFAIQLMGFFFMTVFMFALAIPYDHWTKKENRIGFVVMYSLTFFFANFGPNATTFVVPAEIFPARLRSTCHGISAAAGKAGAIVGAFGFLYAAQSKDPTKTDKGYPTGIGIKNSLIMLGVINFAGMLFTLLVPESKGKSLEELSGENEDGAEGIELPASARTVPV

SEQ ID NO: 12566 - protein, 324 aa, Ajellomyces capsulatus
MENYQKIEKIGEGTYGVVYKARDLTHPNRIVALKKIRLEAEDEGVPSTAIREISLLKEMHDPNIVRLLNIVHADGHKLYLVFEFLDLDLKKYMEALPVSEGGRGKALPDGSTLDMNRLGLGEAMVKKFMAQLVEGIRYCHSHRVLHRDLKPQNLLIDREGNLKLADFGLARAFGVPLRTYTHEVVTLWYRAPEILLGGRQYSTGVDMWSVGAIFAEMCTRKPLFPGDSEIDEIFKIFKLLGTPDENTWPGVTSFPDFKASFPKWKREDTRKLVPGLERNGLDLLDAMLEYDPARRISAKQACMHPYFQAGSSAYSGRERLQPYP

SEQ ID NO: 12567 - protein, 320 aa, Zea mays
MGILALITGKAGASGFGSASTAEHVTDGADASRLTVAITGGASGIGLETSRVFALRGAHVVIAARNTEAASEARKTIMEKNPTARIDVLKLDLSSLKSVRAFVDQFNSMKLPLNILINNAGVMFCPFQLSKNGVEMQFATNHLGHFLLTNLLLDTMKATAKSTGIEGRIVNLSSVAHHHTYPKGIDFDNLNDEKIYNDKMAYGQSKLANLLHAKELSRRLKEEGANITVNSVHPGLIMTNLMRHSFVLMKVLQVATYILWKNVPQGAATTCYVGLSPQLKGVTGKYFADCNVEKTSKLARSEELAKQLWDFSEELIKSAK

SEQ ID NO: 12568 - protein, 135 aa, Triticum aestivum
  unsure (1)..(135): unsure at all Xaa locations
EWWEWVSLVSPFFFWGTAMVAMKGVIPKTGPFFVAALRLLPAGALVVAFAAARGRKQPSGWAAWGAIAAFGLIDAACFQGFLTEGLQKTSAGLGSVIIDSQPLXVAILAALFFGESIGAIXAGGLVLGVVGLFAP

SEQ ID NO: 12569 - protein, 187 aa, Fragaria x ananassa
MRKPCCEKTETTKGAWSIQEDQKLIDYIQKHGEGCWNSLPKAAGLRRCGKSCRLRWINYLRPDLKRGSFGEDEEDLIIRLHKLLGNRWSLIAGRLPGRTDNEVKNYWNSHLKKKILKTGTTLRPNKPHENNHAPNNKLVKLFNKMDDEVVDEVSSADSAAGCLVPELNLDLTLSIKTSTGMADPQVA

SEQ ID NO: 12570 - protein, 108 aa, Klebsiella pneumoniae
MSQTSFNKAQFQAALTRQWQHFGLQSASEMTQRQWWRAVSGALSELLSAQPVAKATEGERHVNYISMEFLIGRLTGNNLLNLGWYQQVSDELQAHDVNLTDLLEEEID

SEQ ID NO: 12571 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGALDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12572 - protein, 309 aa, Streptococcus pneumoniae
GFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHNVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGISYGSLFDATQTKVLDVDGKQLVKVVSWYDNEM

SEQ ID NO: 12573 - protein, 334 aa, Methanosarcina mazei Goe1
MAPIEGCNMEVLWLAQEEVKSVMDMHSDMQVVERAFRQHGLGKVQMPPKSYLYYTAYNGDLRTMPAYLEEEDITGVKIVNVHPGNPTRNLPTVMALIILISPETGAPVAIMDGTYLTDIRTGAAGGIAAKYLARKDSKVIGLVGAGNQARTQLESLCEVFEPESVRITSRTKESCEQFIRDMADIVPCEIHYEESIEKVCDCDILVTTTPSRKPIVKASWIKEGTHINAIGADAVGKEELDPEILLRAKVIVDDMIQALHSGEVNVPLSKHYISENDIHAQLGEVMVGLKPGRTSEEEITIFDSTGLAIQDVATAHLVYERAVREGLGRQVRMF

SEQ ID NO: 12574 - protein, 410 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 12575 - protein, 325 aa, Thermoanaerobacter tengcongensis
MGKVAVIFTGGTIAMKQDPNLKGAVPSLTGKDLLEIIPHRENVLEIETIEFGNYPSPHLTVELLEELREVVEKTLKRDEIKGVVITHGTDTLEETAYFLELTTNFDKPIVLTGAMKNSSEAGYDGPSNLIDSLTTASSEKSKKRGVLVVLNGEIHSAKDVTKTHTSSLDTFKSPETGPLGYVDSGNVYFYRNVEKRQYIPTKKLERRVSLLKVVFGMDDKLIRFLVENGERGIVIEGTGRGNVPPKVAEGIKYAISKGTVVVLVSRCPMGRVHPSYAYEGGGKHLESLGVIFGGNLSGQKARVKLMAALAYTSDYRKIREIFEEE

SEQ ID NO: 12576 - protein, 280 aa, Bifidobacterium longum DJO10A
MFTLEVFPPKRNAPVGTIYDTLDGLEGLNPDFISVTYGHGTHSDRTATARIAHTISKEYGIPAVAHLTALYSDKAKIDEALDMFEEAGVSAVLALRGDYIDGEQLVGEFNHASDLVSYIRSVKPDFKVFGACYPEGHYQADSLDQDIENLKIKVDAGVTHLISQLFYDNEDFYRFLDKARAAGITVPIEAGIMPVRGAKSVRRMAERNASRIPDRLNTLLNKWGDDIQSLRAAGILYASEQIADLVAHDVDGVHLYSMNHPATTRRIWRNAEPLFRGTQG

SEQ ID NO: 12577 - protein, 166 aa, Zea mays
  unsure (1)..(166): unsure at all Xaa locations
MDAVMFGLETPLMAALQHLLDVPDGDAGAGGDSDNKTGGGATRTYVRDARAMAATPADVKELPGAYAFVVDMPGLXGTGDIRVQVEDERVLVVSGERRREEREDDAKYLRMERRMGKFMRKFVLPDNADVDKVAAVCRDGVLTVTVEKLPPPEPKKPKXTIEVKVA

SEQ ID NO: 12578 - protein, 458 aa, Glycine max
MSITHSLTTSLSSSSSAFLAPSSFNSRGQVSLPVKSVSICKCVATPEAETAYKTGVTRNPNMGKLQAGYLFPEIARRRSAHLLKYPDAKVISLGIGDTTEPIPEVITDAMSKRSHALSTIEGYSGYGAEQGEKPLRRALASTFYSDLGIEEDDIFVSDGAKCDISRLQIVFGSNVKMAVQDPSYPAYVDSSVIMGQTGLYQKDVEKFANIEYMRCNPENGFFPDLSSISRPDIIFFCSPNNPTGAAATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPDGLKAMRDVIGFYKENTDIIMETFDSLGFKVYGGKDAPYVWVHFPGRSSWDVFAEILEKTHVVTTPGSGFGPGGEGFIRVSAFGHRENVLEACRRFKQLYK

SEQ ID NO: 12579 - protein, 299 aa, Candidatus Carsonella ruddii
MNLFNFVKKKIKISIDSADLNLIKKYNFDSLTSNPSLILLSFLNNSYNKILKFFFKNNNKKILLDPDTEISFYDYLLIFVVCNLIKFIKDKISIEIPARISYNYNKIIIYSQKILFLCDQFGINKNRILIKIPATDSGIKAASKLKLSGIECNLTLIFDLNQVKKCFDNEIYIISPFVGRISDIINCNFDSGVNFVKNIYNYKKNYNYKTKIMAASFRNLNQILNLLFCDYITISPIYFEKLLNKKINFNINDFQIFKINFNLNFLNLISSKLLINGIIQFEKDHNSLIKLIYFLINNF

SEQ ID NO: 12580 - protein, 156 aa, Zea mays
MDAVMFGLETPLMAALQHLLDVPDGDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 12581 - protein, 523 aa, Zea mays
  unsure (1)..(523): unsure at all Xaa locations
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVXFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 12582 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 12583 - protein, 175 aa, Oryza sativa
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 12584 - protein, 428 aa, Chlamydophila pneumoniae CWL029
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 12585 - protein, 448 aa, Methanococcus maripaludis
MNMNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 12586 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 12587 - protein, 539 aa, Ipomoea batatas
LGRLASCFLDSMATLNLPAWGYGLRYKHGLFKQRITKAGQEEIAEDWLEKFSPWEVARHDIVFPIRFFGHVEVDPSGSRKWVGGEVIQAVAYDVPIPGYKTKNTISLRLWEAKASAEDLNLSQFNDGQYESATLLHSRAHQICAVLYPGDATESGKLLRLKQQFLLCSASLQDIIFRFKERNDGKGTLDWSTFPTKVAVQLNDTHPTLSIPELMRLLMDDEGLGWDEAWDITTRTIAYTNHTVLPEALEKWSQAVMWKLLPRHMEIIEEIDKRFIAMIQSKIPNLESKISAICILDHNPQKPVVRMANLCVISSHTVNGVAQLHSDILKDELFIDYVSIWPTKFQNKTNGITPRRWLRFCNPELSDIITKWLKTDEWVTNLDLLTNLRKFADDEQLHAQWESAKMASKQRLAQYILRVTGVRVDPNTLFDIQVKRIHEYKRQLLNVLGVVYRYKKLKEMKPEERKNTTARTVMLGGKAFATYTNAKRIIKLVTDVGDVVNSDPEVNSYLKVVFVPNYNVSVAEVLIPGSELSQHISTAG

SEQ ID NO: 12588 - protein, 466 aa, Triticum aestivum
PCLLIAYMGQAAYLMKHPLAVERIFYDSVPEVLFWPVFVIATLAAMIASQAMISATFSCIKQAMALGCFPRIKIIHTSKKVMGQIYIPVMNWFLMIMCIIIVATFRSTNDIANAYGIAEVGVMMVSTALVTLVMLLIWQTNLYLVLCFPIFFGAMEFIYLTAVMSKLLEGGWLPLAFSSLFLCIMYTWNYGSVLKYQSEMRGKISLDFILDLGSTLGTVRVPGIGLVYNELVQGIPSIFGHLLITLPAMHSTIVFVCIKYVPVPYVPLEERFLFRRVGQKDYHMFRCVARYGYKDVRKEDHGSFEHLLVESLEKFLRREAQELALEVSTMEAERDDVSEVSEIVPSSPAIAAEDLHTPLLSDQRPGDDSRMLGMEGSVPLLPSSSMSAEEDPSLEYELAALREAMASGFTYLLAHGDVRARKQSFFTKKFIINYFYAFLRRNCRGGTATLKMPHSNIMRVGMTYMV

SEQ ID NO: 12589 - protein, 392 aa, Corynebacterium glutamicum ATCC 13032
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 12590 - protein, 426 aa, Pennisetum glaucum
MDDHANSMEEIIIPDPFWEDLPPPPEPPLVVSDGFTDGVVTNGGGEGTGATDQNQSPSEWSFERLLEEELLIDATPLENFSGSAPHADTTVVDEVDRATTMVPAAVSTVGDPMEYNNILKRKLDEDLATVAMWRASSVVHLEHSQDSNNHIGGDKNFVQNMLSISDSPIKRVRNTYSRARLASSSSSRDPSPSDDDDMDGEVEILGFNMPTEEKMRKRKESNRESARRSRYRKAAHLKEMEDQVAQLKVENSSLLRRLATLNQKYTDATVDNRVLKANMETLRTKVNMAEDALKRITGTMSSSQPLSRPSPLVPAAANADASGHILDNIIIDYLMNSTDATIDHSFELRTTAPPAPAFSQAETPAVGTNSAMISRMAAHHAVAVELLHKRLGGGAMPPATTFSGVAPPETAALPSDVVESTDMGIH

SEQ ID NO: 12591 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 12592 - protein, 128 aa, Oryza sativa (indica cultivar-group)
MADPELEAIRQRRMQELMAQRGAANPQNTGQQKAQEDAKQEAEERRQMMLAQILSSEARERLSRIALVKPDKARGVEDVLLRAAQSGGISEKVSEERLISLLEQINTHTSKQTKVTIQRRRSVLGDDD

SEQ ID NO: 12593 - protein, 178 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLSKFFSFFNNISLVPKLLLSFKWLPIDSNHLPLQ

SEQ ID NO: 12594 - protein, 465 aa, Mazzaella leptorhynchos
  unsure (1)..(465): unsure at all Xaa locations
AKMGYWDPEYXVKDTDVLALFRVCPQPGVDPVEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQMYERAEFAKELGSIIVMIDLVIGYTAIQSMAIWARKNDMILHLHRAGNSTYSRQKIHGMNFRVICKWMRXXGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALESMVIARNEGRDYVAEGPEILQDAAKTCGPLQTALDLWKDISFNYTSTDTADFVETPTANV

SEQ ID NO: 12595 - protein, 307 aa, Escherichia coli
MNAKVWVLGDAVVDLLPESEGRLLQCPGGAPANVAVGVARLGGNSGFIGRVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 12596 - protein, 475 aa, Gracilariopsis tenuifrons
ERYESGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAVAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNESRDYVAEGPEILRDAAKTCGPLQTALDLWKDITFNYTSTDTADFVETPTANV

SEQ ID NO: 12597 - protein, 410 aa, Zea mays
WPPPARARLSVCQRCCGEITGEGGFAFVASADKAGAGDLRAAEAAREMAWEQLHSGPWSEVGTAWRDAYALACLNVARLRTHAASGGDSDRSAALRALDMGLIMGGNLLRADLEAALARISAEACGGSEGGEGVVDKEDQRWREALDRNRDIADALKILPANSLSCKKVERRSCISLEEFICNYFLRDTPVIISGTIDHWPARTKWKDIEYLKKIAGDRTVPVEVGKNYVCSEWKQELITFSQFLDRMSSTVCPSNLTYLAQHPLFEQIKELSEDIIVPEYCYAGGGALQSLNAWFGPEGTVTPLHHDPHHNILAQVLGRKYIRLYPAFIAEDLYPHTETMLSNTSQVDLDNIDLKEFPRVENLEFIDCILEEGDLLYIPPKWWHYVRSLSTSFSVSFWWRAAVQPSGGS

SEQ ID NO: 12598 - protein, 461 aa, Oryza sativa
MAMASARCRTRACATVAYKAMEPNAGGGVVSCDLGLIDMGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRMSVKTTPEMGEEEAAAMPTAILLMQCKELKTSVLTPAMLASACTLHLHGRCTTTASPSIAATPRAEEHEEYSTLSQAIRLSLQAASEEEAGRMHSTAQLAAGKM

SEQ ID NO: 12599 - protein, 95 aa, Buchnera aphidicola
  unsure (1)..(95): unsure at all Xaa locations
AXXXXXXXXXYEPAGGSAPDIAGKNIANPIAQILSIAMLVRYTMKLPIISDQIESAVIDTLKKGYRTLDIANDKEKCESTNDIGDIISYILKKRI

SEQ ID NO: 12600 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPERQERFIRRWIEALSDPRITHEIRSIWISYWSQADKTLGQKLASRLNVRPSI

SEQ ID NO: 12601 - protein, 309 aa, Triticum aestivum
FRRAAWGLLQLSSSGNPLQTSAFIVENIFAIAIGAISLILFAQLIGKMQTYLQSVSKRLEEWRLRQRDMEEWMRHHRLPPDLQERVQRFVQVKWLATRGVEEESILQALPADIRRDVQRHLCLDLVRRVPFFAEMDDQLLDAICERLVSFLCPEGTYISREGDPVSEMLFIIRGKLESSTTNGGRSNFFNSILLRPGEFAGEELLTWALLPKTNIHFPLSTTSAPRPPRGPAFALRAEDLKFVANQFRRLHSKKLQHTFRFYSHHWRTWGACFIQAAWRQHQRRKLSESLSRWESYSWWSEEHPVRRQA

SEQ ID NO: 12602 - protein, 377 aa, Glycine max
  unsure (1)..(377): unsure at all Xaa locations
VKTQVQVQVLQGQISCTLQLVVETHNHQHQHHSHHHHHHHQFPINTFHLQSGGSDHCFQSDQVSPHPSVKSEASTSQLHAPIFHYPLMRGNLHNTMHHHHPQQQGGSPTSSTGEVEAIKAKIIAHPQYSNLLEAYMDNLXIGAPPEVVARMAAAKQEFEARQRSSVGSRETSKDPELDQFMEAYYDMLVKYREELTRPIQEAMDFMRRIETQLNMLCNGPVRIFSDDKCEGAGSSEEDQDNSGGETELPEIDPRAEDRELKNHLLKKYSGYLSSLKQELSKKKKKGKLPKDARQKLLNWWELHYKWPYPSESEKVALAESTGLDQKQINNWFINQRKRHWKPSEDMQFMVMDGLHPQSATLYMDGHYMADGHYRLGP

SEQ ID NO: 12603 - protein, 452 aa, Gelidium linoides
ETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLIKGIFFEQDWASLRKVTPVASGGIHCGQMHQLLDYLGDDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 12604 - protein, 304 aa, Haemophilus somnus 2336
MMTHHSLKHISDRIKQALNQIENRNLAQDLWYILGEQNFQGFLPAFTVNHFCEKYHMTDKELALILLPVSACYANPTISHFSVGAIAKGESGNFYFGANQEFCTTNIQQTVHAEQSAISHAWMRRESKITEITVNYTPCGHCRQFMNELNSAETLRIHLPHSQDNLLHHYLPDAFGPHNLQIDNRLFDKKAHNLFLITEDPLIQAALDAANQSHAPYSKTYSGIALQLQDQQIFQGSYAENAAFNPSLPPLQTALNYLLLNGNEVENIARAVLVEQPFRLSYRGMTEELLAYLGDIPLDYIQVS

SEQ ID NO: 12605 - protein, 338 aa, Desulfovibrio vulgaris subsp. vulgaris (strain Hildenborough)
MRKTRIGINGFGRIGRQVFRAIHERYGDKAEVVAINDLFDAATNFHLLEYDTNYGRAPFTPEVDGNMARVGDWQVTCFAQRDPAQLIWGDVGVDVVIESTGIFRSAKQAHVHIENGAKKVIISAPAKEEDITIVMGVNHHAYDPQKHHVVSNASCTTNCLAPVALIIQEKYGIATGAMTTVHAYTNDQRILDLPHKDLRRARAAGLNIIPTSTGAAQAVAKVIPELKGKFTGYSLRVPIPTVSVVDFTAILERDATTEGLRADLKEAAQGRLSGILAFSEKPLVSSDFKGDPHSSIVEAEYTTVQDGRLAKVVAWYDNEWGYSCRLADLIMLMQEKGL

SEQ ID NO: 12606 - protein, 118 aa, Glycine max
  unsure (1)..(118): unsure at all Xaa locations
DLILEDLSLNVDTSAEQPVSTKDXXKSVKQHAASVLQVDPKYLNAENELRRIFGSKVVKSFESSNQVGSSRQMRGVXXRVHYNLXXSVLVTPSDNWLRCDDSLVMQXXEXXXGYNYFR

SEQ ID NO: 12607 - protein, 481 aa, Zea mays
MCVVIFIGTNGQTYFITASLVTSIQNFPKSRGPTVGILKGFMGLTSAILTQVYTVMHTPDHAALIFMVAVGPSLVAIGLMFVIRPVGGHRQIRPSDKNSFMFIYTVCLLLASYLVGAMLIQDFLQPSYDVVVFLTVILFVLLISPIAIPVIVSFMPEKAQHLMEDALLSEPLTGEASSSRQKEDQPEVILSEVEEEKSKETDSLPPSERRKRIAELQAKLVEAAARGGVRIKRRPHRGDNFTLMQALVKADFWLIWLSLLLGSGSGLTVIDNLGQMSQAIGYKNAHIFVSLVSIWNFLGRVGGGYFSEIIVRERTYPRHIALAVAQIVMAAGHFLFAMAWPGTMYIASLLVGLGYGAHWAIVPAAVSELFGVKHFGAMYNFLILANPAGSLIFSELIVSNLYEHEAEKQASQHQMSALLSPRLLRDTGFLADDALKCEGPACFFFSSLIMSVFCAVAAGLSLLVVQRTRQVYPRLYSSVRT

SEQ ID NO: 12608 - protein, 433 aa, Borrelia burgdorferi B31 [sequence omitted]

SEQ ID NO: 12609 - protein, 492 aa, Triticum aestivum
  unsure (1)..(492): unsure at all Xaa locations
PVNARANPGPRRRHFGHRAHLTKHHDFDSSYQIGYYISVPGAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWHRPPVLALAFFVFFGSIEALYFSASLTKFLDGAXVPLLLALILVAVMFVWNAKILKKYEFDLHNKVTMEWLLALCDRLGMVRVPGMGLVYTDLTSGVPANFSRFVTNLPAFHRVLVFVCVKSVPVPRVLPAERYLVGRVGPPGHRSYRCIVRYGYRDVHQDVDSFETELVESLASFIRLDALFRCSDARSDADYERENAFTVIGSNPLRPRISYDDTHDSASSVEIRVESPTGSNGTNTMELTAMPAAAPRVVKRVRFLVDPGSPDVEDKQMLEELHELCEAREAGTAFIMGHSHVKAKPGSSLLRRLAIGYGYNFLRRNCRGPDVVLRVPPASLLEVGMVYVL

SEQ ID NO: 12610 - protein, 362 aa, Xylella fastidiosa Dixon
MSISFDIARSLSTTSDEELSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVPSAPETSLYFRPFMIATEAYLGVRAAQHASYYLIASPAGPYFAKGVAPVSIWLSTDCARAALGGTGAVKCGGNYAASLLPQQVAQAQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 12611 - protein, 405 aa, Glycine max
MVLEATMICIDNSEWMRNGDYSPSRFQAQADAVNLICGAKTQSNPENTVGVLTMAGKGVRVLVTPTSDLGKILACMHGLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAAAAAAGGVSGFEFGVDPNLDPELALALRVSMEEERARQEAAAKKASEDASKQEKDGEQQASPQDTTMTEGASAAASEAETKRTDLTDDENALLQQALAMSMDDPTINHEVRDTDMSEAAAEDPELALALQLSVEDSSKDSASQSDVSKLLADQSFVSSILASLPGVDPNDPSVKDLLASMQNQSEPQQKNEDKPPNEEEKK

SEQ ID NO: 12612 - protein, 153 aa, Triticum aestivum
MGGDKDRGFHGYPPAGYPPGPGAYPPAGYPPHQGYPPPPGAYPPAHGYGGYPPASGHAGYAPTGYPAHHSGHAGGIGGMIAGAAAAYGAHHVAHSSHSPYGHAAYGHGYGHGHGYGYGHGKFKHGKHGKFKHHGGKFKRGHGMFGGGKFKKWK

SEQ ID NO: 12613 - protein, 287 aa, Saccharum hybrid cultivar H65-7052
IERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPADMPLEDGWGAAPASNNHK

SEQ ID NO: 12614 - protein, 344 aa, Zea mays
VLILSGARQRDQAKAILSKQAVKIATKAEQHERFIFKVTHLLGVLGFGGFCYLLGARPQDVPYVYCLFYVIFVPLRWIYYRYKKWHYYLLDFCYYANTFLLVMILFYPKDEKLFMVCFSFAEGPLAWALIVWRCSLVFGSFDKLVSVLIHLLPGIVLFTIRWWDPQTFAAMHPEGRDARVTWPYVEDKSYMWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQVERKQQKKLEMKPIEQGSWTQGAPADGTYIG

SEQ ID NO: 12615 - protein, 341 aa, Streptococcus mutans UA159
MTVDLDWKNLGFEYHKLPFRYISYYKDGKWDDGKLTEDATLHISESSPALHYGQEAFEGLKAYRTKDGSVQLFRPNMNAERLQRTADRLLMPQVPTDKFIDAAKQVVRANEEYVPPYGTGATLYLRPLLIGVGDVIGVHPADEYIFTIFAMPVGNYFKGGLAPTNFLIQDDYDRAAPHGTGAAKVGGNYAASLLPGKVAHERQFSDVIYLDPATHTKIEEVGSANFFGITKDNEFITPLSPSILPSVTKYSLLYLAEHRFGMKAIEGDVCVDELDKFVEAGACGTAAVISPIGGVQHGDDFHVFYSETEVGPVTHKLYDELTGIQFGDVKAPEGWIYKVDD

SEQ ID NO: 12616 - protein, 414 aa, Physcomitrella patens
MVLEATMVCMDNSEWMRNGDYSPTRFQAQADAINLICGAKTQSNPENTVGVLTMAGKGPRVLITPTNDLGKILQALHGLEVGGEMRMTSGVQVAQLALKHRQNKHQRQRIVLFAGSPVLADKAVLEGMGKKLKKNNVALDIVSFGEDDGEKVEKLEALLNAVNNGDNSHIVHIPGGERVLSDVLISSSIFTGDGEGGSGFAAAAAASAAAAAVGGGGGAYDFGVDPNLDPELALALRVSMEEERARQEAAMKRSAEDSTAKGQQAGESSSAPDVAMSDVGLVDTTDKSKDMMIDDDTALLQQAIAMSMAQAAQAAAAAGGGPATTDTSMEESGGDDQDLAYALQMSMQQAAAAASAAQGSADVNQVLGDQSFVSSVLSSLPGVDPNDPNVRDVLASLQTDEGKNDDQATKDKSK

SEQ ID NO: 12617 - protein, 345 aa, Glycine max
  unsure (1)..(345): unsure at all Xaa locations
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVXAGGFTSCRKSISQAEIYDPEKDVWIPMPDLHRTHNSACSGVVIGGKVHVLHKDMSTVQVLDNAGQWTVEEYGWLHGQMAVIRDALYVISYGLIIKQDKKMRKVVGSASEFRRRIGFAMIGLGDELYVIGGVIGPDRWNWDIKPLSDVDVLTLASDRPTWRQAAPMTRCGGTILGCTLLRI

SEQ ID NO: 12618 - protein, 408 aa, Azotobacter vinelandii
MERADRPMKKSALMAVEAALECLLQLAEKEPIGDVERVALDDAEGRVLAEPLIASLDLPPWPNSAMDGYALRLVDWTGEPLAVSQTIFAGQAPEPLQSGTCARIFTGAPVPEGADCVELQENTELLEDGRVRFSQALRPRQNIREQGQETRCGETVLAAGTRLGPAQLGLAASLGIVELPVRRRPRVALLSTGDELVRPGQPLGPGQIYNSNRTLLLSWLKRLGCSVLDAGILPDDPQLTRARLEELGEADLILSTGGVSVGEADCLGQILREEGELDLWKLAIKPGKPLTVGRYRGVPVIGLPGNPASSLVTFALLARPYLLRRLGVRAVMPLAFQVPAGFAWSKPGKRREYLRARLENGRAVLYPNQSPGVLLSAAWADGLVEVIEDTTLAEGDSVRFIPLSEVLG

SEQ ID NO: 12619 - protein, 228 aa, Schizosaccharomyces pombe
DRCGLLLERHAKIATDGQKPFLKKDSDFKEVPSGDIDLETAISLIKPTVLLGCSGQPGKFTEKAIREMSKHVKHPIIFPISNPTTLMEAKPVQIDEWSNGKALMATGSPLPPLTRNGKEYVISQCNNALLYPALGVACVLSRCKLLSDGMLKAASDALATVPRSLFVADEALLPDLDNAREISRHIVFAVLKQAISEGMSTVDLPKDDAKLKEWIIEREWNPEYRNFV

SEQ ID NO: 12620 - protein, 209 aa, Ranunculus bulbosus
  unsure (1)..(209): unsure at all Xaa locations
AHEISVLCDADVALVIFSIKGKLXEYSTNDRMEGILERYERYSYTSTELVAADPESQECLSMEYXKXKSKVEALQRSQRYFMGEDIGSXGVKELQALEQQLDTSLRQIRSRKNQLMAGSITELQKNEKALLEENIXLKKQAKEKELALSLCEQLNPVERSPYVPLPDAVPALNTSEPTNQSSGSXGEEEVXAQPSQTKTLMPPWMLHHL

SEQ ID NO: 12621 - protein, 959 aa, ASPERGILLUS NIDULANS FGSC A4
MRSRIPNILKPWGRQETQGDTPVVRRNRNQLPMLHLADTTRNNLIAMTGEFVGTFLFLFFSFAGTQVANTPKPVEGAPPNTDALLYSALAFGFSLMVNIWAFYRVTGLLFNPAVTLALCLVGGMPAYRGLFVFAAQIVGGIAAAGVVSALFPGDLNVSTRLGGGASISQGLFIEMFLTAQLVFVIIMLAVVKHKGTFLAPVAIGIAFFVTEMIGDYYTGGSLNPARSLGPDVINRSFPGYHWIYWVGPLLGSLLACGFYYFLTFFSYESVNPGQDFNEWEAKWGPGPTSWDSSMRQHSHSDTTTLNRGMSPRDSRAARNGNGDWNGAHGAHVPPPPGEEQSHSPPISFAHETPGYKPWLDQRRSLELLAWHLLNRGVGVPTHRETRRASLISFPPLLPFTIFISIHAAHLSIVATMGKQTDVRPPSPGLGDTYDQQLLAKLGYKQELRRSYSTLQIFAIAFSIMGLVPSIASTIPFSLPAGPAGMVWGWLTASILIFTVGLAMSDMASSMPTAGGFYWWTHYFAGKKFKRPLSFLVGYSNTLGLIGGICSVDYTLSLLILACISIARDGNWSASNGIIYGLYAGLILVHSVATIVTSNIMPRIQTACIFINVGLIIATVVALPVGKVTRGGTLNSGSFVFGHIDNLSNWPTGWNFVLAFMSPIWAIGFFDSCVHMSEEARDAPKAVPRGILFSAGSACLLGFLVLSVLAAVMDPDVAKTAGTVYGQPMAQIYYDSLGKRGALGFMAVLILIQFLIGLSLIVAASRQVFAFSRDYALPFSPILRKITSLNGQPQPINAIVFLGGICVIFGLLALINSVAANALFSLFVASNYVAWGTPILCRLIWSKRFVPGAFYTGPKVSSIIAGIAVAWLGFGLLLSMFPTVKNPGPAEMNYTVVINGFVWIASMLYYAVYARKVFTGPRVTLAEGEGVSSSFIGTQAEAAREVNNEKEVGTDTSPAG

SEQ ID NO: 12622 - protein, 845 aa, ASPERGILLUS NIDULANS FGSC A4
MSFQKVDPAQIESVLSKLTLEEKISLLAGKNFWETQDYPEKGVPPVKTSDGPNGARGATFKGGVTAACFPASSLLAATWDLDAAKHIGEALADETRSKGARVLLAPTVCIHRHPLGGRNFESFSEDPFLAGKLAAQYIKGLQGNGVAATIKHYAANEQETCRFTVNEHITERALREIYLKPFEIAIKESNPLAVMTAYNIVNGTHADSNNFLLRDVLRGEWGWKGLVMSDWGGTNSTADALNAGLDLEMPGPTRWRKVDEVLAVVKSGAVLEETIDERARNVLELLAKLNCFENPTIPEEKAINRPEHQKLIRSVGSQGLVLLKNEGDVLPLRKEILTNKKVALLGFAREALIHGGGSASVNAHYRVTPEEGLRAALGDTVEFEYAKGAHTFRQLPLMSDNVVNLEGQPGWTLDFFADEEPNGEPGSSISSEQPSYIPLFVKESWGSVRASAHFTPTQSGKHYFGMSGLGRSKLLIDGEVIYEQKLNCPDSMGFLLGGVEEPEIQYSFEAGKTYAVEVVSVKPTSKGGLALLDGFIGFRLGFMTEEEHNRDLLSEAVDVAKRSDIAIVFTGHTPDWETEGQDQISFHLPSNGSQDRLVAAVGAANPNTVVVNCTGVAVAMPWLDKVKAVVQAWFPGQEAGNAIADVLTGAVNPSGRLPVSFPRAIEDAPAHGNFPGDYTDGKDNRRHLEVTYKEGVFVGYRHYDLSEANRAKVLFPFGYGLSYTTFTHANHKASATSRNTVEVAVDVTNVGTCAGADVVQVYAGAKLAVPENPVKELVGFAKVHLKPGETKTANITFEVRQLTHFTERSGKWELESGDYEISIGQSVRDITGKVEIGLEAQNYKP

SEQ ID NO: 12623 - protein, 326 aa, Escherichia coli
LPNITILATGGTIAGGGDSATKSNFTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 12624 - protein, 545 aa, Oryza sativa
  unsure (1)..(545): unsure at all Xaa locations
MELGLGMGMGLGDPPADYGSIAAVGMFVALICVCIVVGHLLEESRWMNESITALIIGLGXGGVILXXSSWKHSRILVFSEDLFFIYLLPPIIFNAGFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTITVVLFSTMVFGLLTKPLIRLLIPARHLNRESSALSDPPSPKSFLDPLILNGSDVDPEIGVGIRRPTSLRLLLASPTQSVHHYWRKFDNAFMRPVFGGRGFVPFVPGSPTERSVPLLQGNEN

SEQ ID NO: 12625 - protein, 748 aa, Zea mays
  unsure (1)..(748): unsure at all Xaa locations
LGTSRPAGYYLSDHTKCALMSSAYVHLHCKDYLKXTKDISSLSQRVLLSGPTGTDIYQEYLVKALAKNFGARLLTVDSSMLFGGQTSKEPETYKKGDRVRYIGSVQSTGVILDGQSPPDFGSQGEIFLPFEENRSSKVGVRFDKKILGGNDLGGNCEVDHGLFCPVDSLCLDIPGWEVTFKHPFDVIVEFISEEIRHGPLILFLKDTEKICGNNDSYHGLKSKLKHFPAGAFIIGSQIQPDNRKEKANVSSPFLSXKFRYSQAILGLTLQDIDGGNDNNKETSKAIMKHLIKLFPNKVTLEAPQAEMELSRWNQMLNRDIEVLKGNANISKIRSFLTRLGLECTDPEAILVTDRILTNECIDKIIGFALSHQLKNCTNPDPPLGSVQFALSSGSLKHGVDMLKSIQSGSKSSTKRKSLKDIATENEFEKSLLADVTPPHEIGVTFEDIGALESVKDTLKELVMLPLQRPELFNRGQLMKPCKGILLFGPPGTGKTMLAKAVATEAGANFINISMSSISSKWLGEGEKFVKAVFSLASKIAPSVIFVDEVDGMLGRRENPGEHEAMRKMKNEFMVNWDGLRTREKERVLVLAATNRPFDLDEAVVRRLPRRLMVNLPDASNRRKILSVILAKEDLADDVDLETIANLTEGYSGSDLKNLCVTAAHRPIREILEKEKKELQLTEAENRSLPPSHTSNDVRALRTSDFIHAHEQVCASVPSDSSNMSELVQWNDLYGEGGSRKKTTLSYFM

SEQ ID NO: 12626 - protein, 279 aa, Zea mays
MTMAGSCAAVPVAGLPSLRTPMPTHLRLGGFMPCSSAARSRGAAVLGCALGARKQTPGVLNQLLCRYMRRDGHEGDVSNQGRDGAVMFGPDDDGVKIPTQVETLVKGTAAVAEPEYKQIPDVDYLQELLAIQQQGPRAIGFFGTRNMGFMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 12627 - protein, 158 aa, Triticum aestivum
  unsure (1)..(158): unsure at all Xaa locations
MAPTVMASSATSVAPFQGLKSTAGLPVSRRSNGASLGSVSNGGRIRCMQVWPIEGIKKFXETLSYLPPLXTEALLKAGGTTWIRSKWVPCLXXNKVXSSSRGAHASPRGTNDGRYWXTMWELPMFGCTDXTQVINEVEXVKEXXPDAYSASSVRQHRK

SEQ ID NO: 12628 - protein, 268 aa, Xylella fastidiosa 9a5c
MSNSKVVVITGVSSGIGRATALILAKQGCQVFGTVRNAEKAQAIPGVVLVEMDIRDDVSVERGIQNIMAQAKRIDVLVNNAGVTLLGATEETSVTEAKTLFDTNLFGMLCTIQAVLPHMREQRSGRIVNISSVLGFLPAPYMALYSASKHAVEGLSETLDHEVRQFGIRVALVEPSFTKTNMDLNAPQTASKIPDYSREFDIVSQAIQKNVQKAPDPEGVASTILNAALGRWKMRHTPKGQASRLAKLRRFMPAGPIEKGLRKTFGLG

SEQ ID NO: 12629 - protein, 245 aa, Nicotiana sylvestris
MGRGRVQLKRIENKINRQVTFSKRASGLLKKAHEISVLCDAEVGLIVFSTKGKLFEYSTDSCMERILERYERYSYAERQLTATDDETPGSWTLEHAKLKARLEVLQRNQRHYAGEDLDSLSMKELQNLEHQLDSALKHIRSRKNQLMHESISELQKKDKALQEQNNNLSKQVKEREKELAQQTQWEQQSHDHLNSSSFVLTQPLSSLHLGEAYPTAGDNGEVEGSSRQQQQNTVMPPWMLRHLNG

SEQ ID NO: 12630 - protein, 382 aa, Oryza sativa
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAGASSLFFVYSLDYARTRLANDAKAAKGGGERQFNGLVDVYRKTLKSDGIAGLYRGFNISCVGIIVYRGLYFGMYDSLKPVVLTGSLQDNFFASFALGWLITNGAGLASYPIDTVRRRMMMTSGEAVKYKSSMDAFSQILKNEGAKSLFKGAGANILRAIAGAGVLSGYDQLQILFFGKKYGSGGA

SEQ ID NO: 12631 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYHGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12632 - protein, 111 aa, Zea mays
FKPNPRSHVQEYCLVVSFLSHLAESLHTFFFLFDYLVVPSDYRHMEGFGVNTYTFVSSAVKAHYFKFHWNLYFCIRFILTFYFSFLFSYSFLSFFFLFYFFYFYLSFYFFF

SEQ ID NO: 12633 - protein, 469 aa, Methanosarcina acetivorans C2A
MLKNVQKLGKFLIIICMIFIALSSPAFAATAEENAVAIEGVQTALTFVWLLLASGLVFFMHAGFSLVETGLTRSKNTANILMKNFMTIVLGILIYWAVGWGVMYGADAAGLIGTDQFFLSGADNALWNGWFFQMVFAATGATIVSGAMAERTNFKAYLIYCIMMVAVIYPVYGHWVWSGADLALLTGADSPIVQAIGVPSHDFAGSGVVHSIGGYSALAGVLLVGARIGKFKDGKAVPIPGHNLTIAFLGTLILALGWIGFNGGSTLDGNDPYMNLVVVNTFLAAAAGAVVTMLITWMKTGKPDPSLTANGLLGGLVAITAPCGSVNNWAAIIIGAIAGIIIYAGVMFNENTLKVDDPVGAIAVHGYCGSWGLISVGLFSIGIGNGILADAAYAAEVPGLFYGGGISLLLIQLISVLCSIVWAFGISFIIFKILDAVVGLRVSEEEEIMGLDICEHGIRAYPEYLMREE

SEQ ID NO: 12634 - protein, 557 aa, Zea mays
  unsure (1)..(557): unsure at all Xaa locations
MAATVRRAASSVLSRFLLTKPSPSPAASAAGXSPALLGAGAAALRHRFSTAPASAAAAAEEPIQPAVXRVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVAXRCVRYYAGWADKIHGLVAPADGAHHVQVLHEPXGVAGQIIPWNFPLLMFAWXKVGPALACGNTVVLKTAEQTPLSALYVANLLHEAGLPEGVLNVVSGFGPTAGAALSSHMGVDKLAFTGSTGTGQIVLELAEESNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRXGDRGFYIQPTVFADAKDEMKIAREEIFGPVQTILKFSGVEEVIRRANATPYGLAAGVFTRSLDAANTXLSRALRAGTXVWVNCYDVFDATIPFGGYKMSGVGREKGXYALRNYLQTKAVVTPIKNPAWL

SEQ ID NO: 12635 - protein, 447 aa, Synechococcus sp. PCC 7942
MPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKPLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDPGEPLDVDIYDLSPEELAKIPSTPGSLKDALKALEADHDFLTVGGVFTEDFIQNWIEYKLDNEVIPISLRPHPYEFALYYDC

SEQ ID NO: 12636 - protein, 309 aa, Burkholderia fungorum
MATLRTDFANLFAPLFFPMLASFIATVFVVSWSTGFVVARAITPYADPNLFLLARFGGAALIFALAALAARAAWPGGRDIGKHLLAGALLQGVYLGAGYWAVAQGLSAGVMALLGALQPLATAAVAAPLFGERLSRRGWAGMALGLAGVVLVLEPKLASSAAPAPHGSAPGWLVVLISIAAVGAITAGTLYQKTSLAKADIRSASAVQNFGAALVAGVFVLALGEHRWIASPTLWASLAWGIVMLSGISVTLLVWMVRRGDAARATALMFLAPPLAALEGYAGFGETLLPVQIAGFAVALVGVLLTRSR

SEQ ID NO: 12637 - protein, 323 aa, Zea mays
MAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 12638 - protein, 451 aa, Eremothecium gossypii
MSEDAGEVYVDKAVSDEIFSKLNSKPENRTCFDCGNKNPTWTSVPFGIMLCIQCSGEHRKLGVHITFVKSSNLDKWTINNLRRFKMGGNHRAREFFLKNNGKQLLDYKADKQVKYTSAVAKNYRARLDKLAAKDREQHPAELVLATDEEQGSSGSSGASSKNNSVDDFFASWEKKSASTPPPKILTPNPTGSSAGAARSSILSAPGRRRTPLAGGGSTGKKHSILSSKRTARPAAKKADADLFDEFEKEAQREQEESAAAVSTETVRTSSNAYVQQKPIKMHAASSSDDDLADNPYNDGTRFDQVRPAPTVEDVQPKLAKLGFGMVNNNASSLMEEARQSKLAAAAPKYTGDVVAKFGAQKAISSDQMFGRGSYDEDSSREARDKLKSDFHNATAISSSSYFGEPEPPALPQPAPFRMDLLGSEEDFELAKQALERSAQKLGNYLRDYIRK

SEQ ID NO: 12639 - protein, 155 aa, Zea mays
ADAWVQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDHGYSPGIGIRNTLFVLAGTNFLGMLMSVFVPESKGMSLEEISKENVDDEAEAEV

SEQ ID NO: 12640 - protein, 488 aa, Laurencia natalensis
MSKPVEERTRIKNERYESGVIPYAKMGYWDPNYVVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIKGFYDTLLEPYLKVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 12641 - protein, 118 aa, Salmonella enterica
NGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 12642 - protein, 473 aa, Glycine max
MSVQDYLDKHMLSRKLEDAVNAAVRAKTSDPVLFISNHMRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKAGAAEKEVPLYKHIADLSGKTSPTLPVPAFTVISGGKHAGSNLAIQEIMILPIGASKFEEALRMGTETYHHLKAVITEKYGAHNCNVGEDGGFAPNISSFREALDLVKEAISRAGYDEKIKIALDVAATDFCIGKRYDLDFQSPQKSGQNFKSAEDMIDLYKELCSEYPIVSIEDPFDKEDWEHIKHISSLGICQVVGDDLLMSNAKRIERAITESACNALLLKVNQVGTITEVIEVVKLAKEAHWGVVTSHRCGETIDSFIADLSVGLASGVIKAGAPCRGERLEKYNQLLRIEEELGDQAVYAGEDWRQ

SEQ ID NO: 12643 - protein, 274 aa, Oryza sativa
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRKYVAEKGVNPWIEVDGGVGPKNAYKVIEAGANAIVAGSAVFGAPDYAEAIKGIKTSKRPVAVPA

SEQ ID NO: 12644 - protein, 346 aa, Pectobacterium atrosepticum
MFNALFVVVFVCFSSLANAAENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 12645 - protein, 518 aa, Ralstonia metallidurans
MHCDTRHPRKEVKQMKTWFKRILTAGAMTLALGTAGLGLSTHAVAQDKPAAEASAATASATPAAAVAAPAAATPAAAPAEAAAAPAAPVPNKGDTAWLLVSTTFVILMTLPGLALFYGGLVRSKNMLSVLMQCLMIFSVISILWAIYGYSFAFTEGNAFFGGTDRLFMKGLTVDAVAATFSKGVVVPELGYFAFQCAFAAITCSLIIGAFAERAKFSAVLVFVVLWFTFAYIPMAHMVWFWPGPDAYTDAAAGTAATAKAGWLFQKGALDFAGGTVVHINAAVAGLVGAFMFGKRIGFGREAIRPHSLTFTMVGASLLWFGWFGFNAGSALEANGSAALAFVNTLLATAAAVVSWTFGEWIGKGKPSMLGGASGAVAGLVAITPAAGFVGPMGSIAMGLIAGLLCLWGVTGLKRLLGMDDSLDVFGVHGVGGILGALLTGVFAAPSLGGTGIYDYVANKVADDYSIAGQVWIQFEGVLTTIVWSGVVALVAYKLIDMLIGLRVPEEEEREGLDITSHR

SEQ ID NO: 12646 - protein, 494 aa, Streptomyces glaucescens
MAARTDNSIVVNAPFELVWDVTNDIEAWPELFSEYAEAEILRQDGDGFDFRLKTRPDANGRVWEWVSHRVPDKGSRTVRAHRVETGPFAYMNLHWTYRAVAGGTEMRWVQEFDMKPGAPFDNAHMTAHLNTTTRANMERIKKIIEDRHREGQRTPASVLPTELHAQQLLLLAASGRLARIVHVLTELRIADLLADGPRHVAELAKETDTHELSLYRVLRSAASVGVFAEGPVRTFSATPLSDGLRTGNPDGVLPLVKYNNMELTRRPYDEIMHSVRTGEPAFRRVFGSSFFEHLEANPEAGEFFERFMAHWSRRLVLDGLADQGMERFSRIADLGGGDGWFLAQILRRHPHATGLLMDLPRVAASAGPVLEEAKVADRVTVLPGDFFTDPVPTGYDAYLFKGVLHNWSDERAVTVLRRVREAIGDDDARLLIFDQVMAPENEWDHAKLLDIDMLVLFGGRERVLAEWRQLLLEADFDIVNTPSHTWTTLECRPV

SEQ ID NO: 12647 - protein, 298 aa, Escherichia coli
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMVARFNETGRSQVLAKRMPGDLSEYSVIQTKEPMVAEGQVARIVEFIEKPDEPQTLDSDLMAVGRYVLSADIWAELERTQPGAWGRIQLTDAIAELAKKQSVDAMLMTGESYDCGKKMGYMQAFVTYGMRNLKEGTKFRESIKKLLA

SEQ ID NO: 12648 - protein, 429 aa, Bacillus cereus ATCC 14579
MVEKRIPIQVAEAVERVMKYAKHGEVEEISITESYGRILGEDVVSDHDVPHFDRSPYDGFAIRAEDTKEATQENPVEFEVIGEIGAGSVFLEEVGAFEAIRIMTGAAIPEDCNAVVMLELTEGFEKNGKTYMKLKRPFNNGDNVSFKGEDIKQNQVLVKKGVAINPGVAALLATFGYSTVKVVKQPVVGIVTTGSELLEVHEPLEPGKIRNSNSYMIAAQIMKAGGKVRYYGQLADELDACFTAVQSAMDEVDILITTGGVSVGDYDYLPAIYERLQANVLFNKIAMRPGSVTTVAEVDGKLLFGLSGNPSACYVGFELFVHPIIKTYLYAKEPHVYRADAILQKDFPKPNPFTRFVRANVTIVDGALQAMPVGLDKSSAVSSLADANAFIVLPGGTRGFETGMKVSVLLLEHSEGCEWPWAKPLQSYK

SEQ ID NO: 12649 - protein, 113 aa, Zea luxurians
  unsure (1)..(113): unsure at all Xaa locations
MGRRACCAKEGVKRGAWTTKEDDALAAYVKAHGEGKWREVPQKAGLRRCGKSCRLRWLNYLRPNIRRGNISYDEEDLIIRLHKLLGNRWSLIAGRLPGRTDNEIKNYWXSTLV

SEQ ID NO: 12650 - protein, 182 aa, Zea mays
MDLWAPGWVSHKTLSRPGRDHQSQLSELSTSFTAKKEPTMISTKRIAQLAKKWQRMEALGRKRRLAWGTAAAAKKADRCCASVASKGHCAVYTTDGARFEVPLACLGTEVFAELLHMSREEFGFAGGHGRILLPCDAMVMEYALCLLRRGASADLEKAFLSTMAMSCHSADHAAAPYVAACC

SEQ ID NO: 12651 - protein, 448 aa, Streptococcus pneumoniae TIGR4
MPITAADIRREVKEKNVTFIRLMFSDILGTMKNVEIPATDEQLDKVLSNKVMFDGSSIEGFVRINESDMYLYPDLDTWTVFPWGDENGSVAGLICDVYTTEGEPFAGDPRGNLKRALRHMEEVGFKSFNLGPEPEFFLFKLDENGDPTLEVNDKGGYFDLAPTDLADNTRREIVNVLTKMGFEVEASHHEVAVGQHEIDFKYDEVLRACDKIQIFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 12652 - protein, 327 aa, Erwinia chrysanthemi
ADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTY

SEQ ID NO: 12653 - protein, 335 aa, Citrus unshiu
MEVERVQAIASLSHSNGTIPAEFIRPEKEQPASTTYHGPAPEIPTIDLDDPVQDRLVRSIAEASREWGIFQVTNHGIPSDLICKLQAVGKEFFELPQEEKEVYSRPADAKDVQGYGTKLQKEVEGKKSWVDHLFHRVWPPSSINYRFWPKNPPSYRAVNEEYAKYMREVVDKLFTYLSLGLGVEGGVLKEAAGGDDIEYMLKINYYPPCPRPDLALGVVAHTDLSALTVLVPNEVPGLQVFKDDRWIDAKYIPNALVIHIGDQIEILSNGKYKAVLHRTTVNKDKTRMSWPVFLEPPADTVVGPLPQLVDDENPPKYKAKKFKDYSYCKLNKLPQ

SEQ ID NO: 12654 - protein, 565 aa, Coxiella burnetii RSA 493
MLDITFKTDKNNKPYLETGITGKALLTIPQLNKGTAFTEEERDTFGLRGKLPNRVETLDDQVARAYLQYKSFDMQLNRNFYLNHLLDTNQVLFHRLVKNHVQEMLPTIYTPIVGNAVRAFNKRFMHPRGLYISYEDRNQIKKILNNRSHPIIDLIVVSDGEGVLGIGDQGVGAMAIPVAKLMVYTAIGGINPIRTLPILLDAGTNNEELLNDPLYLGWRHPRLSGNEYAEFIEKFIEAVQATFPQVFLHWEDFGRTNAYRNLIKYREITCSFNDDIQGTGCVALAAILAALKITRSTLPEQRIAVFGAGTAGMGITDTLFRALSQNGLSEKEARNPFWLIDRNGLLTEYSEEVTSAQQPYLRKKEEIASWKIKNPQQISLLEVIENVKPTILIGASAQSHAFDQTIVKAMAKHVEKPIIFPLSNPTDRSEAEPADLHRWSHGKALIATGSPFEDIIFDNQIFPVNQCNNYLAFPGIGLGAIAVKANRVSDNMLWSASQALSRYANESTHRLLPSIAQAQEASRQVAIAVAKTAIEEGLAKFSLDQVETLVDQQIWEPHYLSYRKR

SEQ ID NO: 12655 - protein, 676 aa, Escherichia coli O157:H7
MKLAACFLTLLPGFAVAASWTSPGFPAFSEQGTGTFVSHAQLPKGTRPLTLNFDQQCWQPADAIKLNQMLSLQPCSNTPPQWRLFRDGKYTLQIDTRSGTPTLMISIQNAAEPVANLVRECPKWDGLPLTLDVSATFPEGAAVRDYYSQQIAIVKNGQITLQPAATSNGLLLLERAETDASAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKTLGERWSDWKPAAGQTWHSFNDYINFSDKTGWDKWWGKNWIRTDIGDYDNPGFDDLTMSLAFLPDIKTESTTASGLPVFYKNKTDTHAKAIDGFTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCIAQMDTTWQQMAEKLQGFNVLSYLSSHDTRLFREGGDKAAELLLLAPGAVQIFYGDESSRPFGPTGSDPLQGTRSDMNWQDVSGKSAANVAHWQKISQFRARHPAIGAGKQTTLSLKQGYGFVREHGDDKVLVIWAGQQ

SEQ ID NO: 12656 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 12657 - protein, 539 aa, Eremothecium gossypii
MSRQVLHSDMRSVGTEVSAASQKKYLMEETVDIPTKPATAYITVCLLCVFVAFGGFIFGWDTGTISGFVNQTDFRRRFAQVNDEGGYYWSNARVGLIVAIFNIGCAVGGIILSRLGDMYGRRIGLMIVSLIYVVGIIIQISSNTKWYQYCIGRVISGLGVGGIAVLSPMLISETSPKHLRGTLVSCYQLMITAGILLGYCANYGTKSRYDDSRQWRIPLGLCFLWAIFMITGMAFVPESPRYLIEKDKIEEAKRSLATSNKVPVDDPAILAEVNNIQAGVELERMAGSASWGELFTVRTKILQRVIMGAMIQSLQQLTGNNYFFYYGTTIFDSVGLEDAFKTSIILGAVNFGSTFVAMYTVDRFGRRKCLLYGAAAMAVCMVIFASVGVTRLWPNGPDQPSSRPAGNAMIVFTCLYIFFFATTWAPIAYVIVSETFPLRVKAKGMAIATAANWIWGFLIAFFTPYITNAIRFYYGYVFMGCLIFAFFYIFFFVPETKGLTLEEVEEMWQEGVVPWRSESWVPSARRHAPYSSDKQAAGI

SEQ ID NO: 12658 - protein, 317 aa, Yersinia pestis CO92
MTDKLTSLRQITTVVADTGDIAAMKLYQPQDATTNPSIILNAAQIPEYRKLIDEAIAWAREQSSDHAQQIVDATDKLAVNIGLEILKLIPGRISTEVDARLSYDTVASVAKAKRLIKLYNEAGISNDRILIKLASTWQGIRAAEQLEKEGINCNLTLLFSFAQARACAEAGVFLISPFVGRILDWYKANGDQKEFAPSEDPGVVSVTEIYQYYKKHGYKTVVMGASFRNLGEIIELAGCDRLTIAPSLLKELAESEGPVERKLAYTGEIQAKPAPLTEAEFYWQHNQDPMAVDKLADGIRKFAIDQGKLEKMISDLL

SEQ ID NO: 12659 - protein, 337 aa, Zea mays
MGKIKIGINGFGRIGRLVARVALQSEDVELVVVNDPFITTDYMTYMFKYDTVHGQWKHSDIALKDSKTLLFGEKPVTVFGIRNPEEIPWGEAGAEYVVESTGVFTDKDKAAAHLKGGAKKVDISAPSKDAPMFVVGVKDDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 12660 - protein, 475 aa, Grateloupia americana
ERYESGVIPYAKMGYWDPDYVIKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKTCGPLQTALDLWKDISFNYTSTDTADFVETPTANV

SEQ ID NO: 12661 - protein, 307 aa, Nostoc sp. PCC 7120
MSIIVFGSINIDLVATAPKLPGAGETLLGEDFFKVPGGKGANQAVALARLGVPTQMVGRVGAQSFGAELMQNLQDAGVQTDNIFVDETASSGVAMITVAHNGENQIVVIPGANGRVNQVDVERLSRILPTATALLLQLEIPVPAVIAAAQAARSNNITVILDPAPAPSDLPTELYSFVDIITPNEVEAGQLVGFPVDGEDAARKAAGVLLQKGVKSAIVKLGAKGVVCATNKETFFVPAFSVDTLDTVAAGDAFNGGLATALYSGLSLHQAVIWGAAAGALAATKLGAQTSLPDKLTFEAFLKERVL

SEQ ID NO: 12662 - protein, 96 aa, Zea diploperennis
MGRRACCEKEGVKRGAWTTKEDDALAAYVKAHGEGKWREVPQKAGLRRCGKSCRLRWLNYLRPNIRRGNISYDEEDLIIRLHKLLGNRWSLIAGRL

SEQ ID NO: 12663 - protein, 53 aa, Zea mays
MAASSAVEKLKVLWDSQVNDEEQWALNYKLLKAAGLFAGSIFLMRNFGDLMAI

SEQ ID NO: 12664 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 12665 - protein, 246 aa, Crocus sativus
MGRGRVQLKRIENTINRQVTFSKRRGGLLKKANEISVLCDVDVALIIFSTKGKLSEYSTDARMETILERYERYSFAESAIAVPEAESQGSWLNEYGRLKARIESLQTSQRHLTGVQLDMLNVKEMQELEQKLESAMKNIRSRKSQLLFNSISDLQTKEKALVDRNNDLKKKIAEKERKRTSAQQGHQDQQGQQYVDPTSPLSFPVQDPPSLTMGINPARSTSDEDRPLPQVNSSKLLPWMIRSVNG

SEQ ID NO: 12666 - protein, 220 aa, Zea mays
PRVRGRVGAAWPEMPYGESGEAAPSLIPYQILSWQPRALYFPQFATSEQCENIVKTAKERLKPSTLALRKGETAESTKGIRTSSGTFLSANEDPTETLAEIEKKIARATMLPRNHGEPFNVLRYNIGQRYASHYDAFDPAQYGPQKNQRVASFLLYLTDVEEGGETMFPYENSENMDIGYDYEKCIGLKVKPRKGDGLLFYSLMVNGTIDRTHLLVGCPV

SEQ ID NO: 12667 - protein, 345 aa, Glycine max
MSGLIERLPDAVAIRCLARVPFYFHPVLELVSRSWQAAIRSPELFKARQEVGSTEDLLCVCAFDPENLWQLYDPMRDLWITLPVLPSKIRHLSNFGAVSTAGKLFVIGGGSDAVDPLTGDQDGCFATDEVWSYDPVVRQWAPRASMLVPRSMFACCVLNGKIVVAGGFTSCRKSISQAEMYEPEKDVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 12668 - protein, 336 aa, Corynebacterium glutamicum
MTIRVGINGFGRIGRNFFRAVLERNGDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASQALN

SEQ ID NO: 12669 - protein, 331 aa, Kluyveromyces marxianus
MVRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 12670 - protein, 335 aa, Thermotoga maritima
STFVAGLEKLKKGEIEPYGVPLAGELPIDFKDIRIVGSYDVDRAKIGKKLSEVVSQYWCDVNSLSDDPVVSTGVHLGSVKNLPIEAZGLEDSMTLKEAIERLVDEWSKLDPDVIVNTCTTEAFKPFGNKEELLKAIENNDKERLTATQVYAYAATLYAKKRGGAPFVNVIPTYIANDPAFVELAKGNNLVVFGDDGATGATPFTADVLSHLAQRNRYVKDVAQFNIGGNMDFLALTDEGKNKSKEFTKSSIVKDILGYDAPHYIKPTGYLEPLGDKKFIAIHIEYTSFNGATDELMISGRINDSPALGSLLVDLVRLGKIALNRKEYGTVYPVNA

SEQ ID NO: 12671 - protein, 990 aa, Synechocystis sp. WH 8501
MVVQLDSTTYEQRTQEIAKELIAQTREKRSLWSKLGDQMRLDDKLLDFAMANPGLRVQLFHFIDTLPALQSNAEIAHHLQQYLGDESVELPSSLKGILNFTDYNSLPAKVAAETISKAVQTLAFKYISGETVPQVIKTVERLRKEKMGFTIDLLGEAVITESEAKAYLDSYLDLMEKLATESKKWSNVAQIDTAGDENLSKVQVSVKLTAFYSQFDPIDPQGSKEKVCTLIRILLRRAQELGVAIHFDMEQYVYKDLTLSILRELLLEEEFRNRSDIGVTLQAYLRDSKQDLHDLISWAKQRGTPITIRLVKGAYWDQETIKSEQNHWPQPVYNQKSATDVNYEEMTQLLLENHQYLYAAIGSHNVRSQARAIAIAETLKVPSRAFEMQVLYGMGDQLAKALVKTGHRVRVYAPYGNLLPGMAYLIRRLLENTANSSFLRQNLEERPIEDLIASPTLSGNTERIAQKESFVNVPDTDYSREVLRDKAEKALAKVKDSLGKTYLPLINGEYVQTDVIVESVNPSKSSEVVGQIGLISVSQAEQALNAAREAFKDWKKTPATERARIIRKAGDLMEERRHELSAWICVEVGKVLQQADAEVSEAIDFCRYYADEMERLDKGYNYDVAGETNRYHYQPRGIALVISPWNFPFAISTGMTVAALVTGNCTLLKPAETSTVIAAKIAEILVDAGIPKGVFQLVPGKGSKVGAYMVNHPDVHLIAFTGSREVGCRIYADAAILQPGQKHLKRVIAEMGGKNAIIVDESSDLDQAVAGAVFSAFGYSGQKCSAASRIIVLDPVYDAFLERFVEATKSLNVGATDQPSTQVGPVIDATAQKRILEYIEIAKQESTLALQMEAPDNGFYVGPTIFGDVLPNHTIAQEEIFGPVVAVMRVKSFAEALGVANGTDYALTGGLYSRSPEHIEQAQKEFEVGNLYINRTITGAIVSRQPFGGFKLSGVGSKAGGPDYLLQFLEPRHISENIQRQGFAPIEGNE

SEQ ID NO: 12672 - protein, 371 aa, Bacillus anthracis str. A2012
MGTKTKKTLFNVDEQMKAIAAQFETLQILNEKGEVVNEAAMPELSDDQLKELMRRMVYTRVLDQRSISLNRQGRLGFYAPTAGQEASQLASHFALEAEDFILPGYRDVPQLVWHGLPLYQAFLFSRGHFMGNQMPENVNALAPQIIIGAQIIQTAGVALGMKLRGKKSVAITYTGDGGASQGDFYEGMNFAGAFKAPAIFVVQNNRYAISTPVEKQSAAKTVAQKAVAAGIYGIQVDGMDPLAVYAATAFARERAVNGEGPTLIETLTFRYGPHTMAGDDPTRYRTKDIENEWEQKDPIVRFRAFLENKGLWSQEVEEKVIEEAKEDIKQAIAKADQAPKQKVTDLMEIMYEKMPYNLAEQYEIYKEKESK

SEQ ID NO: 12673 - protein, 577 aa, Oryza sativa (japonica cultivar-group); identical to SEQ ID NO: 10513

SEQ ID NO: 12674 - protein, 514 aa, Lycopersicon esculentum
MASAMTCSAAELFPHLGSSANATAAAEFICSRFSAVSEYLTNTTYAVDTTYLLFSAYLVFAMQLGFAMLCAGSVRAKNTMNIMLTNVLDAAAGGFSYYLFGFAFAFGAPSNGFIGKHFFGLKEFPSQAFDYSYFLYQWAFAIAAAGITSGSIAERTQFVAYLIYSSFLTGFVYPIVSHWFWSGDGWASASKTDGNLLLRFGVIDFAGSGVVHMVGGIAGLWGAFIEGPRIGRFDRSGRSVALRGHSASLVVLGTFLLWFGWYGFNPGSFLTILKSYDHTIRGTYYGQWSAIGRTAVTTTLAGCTAALTTLFCKRLLVAHWNVVDVCNGLLGGFAAITSGCAVVEPWAAIVCGFIAAWVLIGFNALAAKLKYDDPLEAAQLHGGCGSWGIIFTGLFAKKEYVNEVYPGFPNRPYGLFMGGGGKLLGAQVIQVVVIIGWVSVTMGPLFYLLHKFKLLRISRDDETAGMDLTRHGGFAYIYHDEDEGSSMPGFKMTRVEPTNTSTPDHQNRSVNVVV

SEQ ID NO: 12675 - protein, 440 aa, Glycine max; identical to SEQ ID NO: 6957

SEQ ID NO: 12676 - protein, 240 aa, Medicago sativa
RGKIQIKRIENTTNRQVIFSKRRNGLLKKAKELAILCDAEVGVMIFSSTAKLYDFASTSLRSVIGRYNKSKEEHNQLGSTASEIKFGQREAAVLRQQLHNLQESHRQIMGEELSGLTVKELQGLENQLEISLRGVRMKKEQLFMDEIQELNRKGDIIHQENVELYRKVYGTKDKNGTNRVLSLTNGVGIGDDSNRTCESPAQPATETRTTTALMHSLEISVLTCKQGKWTQILISYMNGI

SEQ ID NO: 12677 - protein, 123 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPPPPPYLCFAALLMAGLD

SEQ ID NO: 12678 - protein, 261 aa, ASPERGILLUS NIDULANS FGSC A4
MGHEDAVYLAKLAEQAERYEEMVENMKVVAASDVELTVEERNLLSVAYKNVIGARRASWRIVTSIEQKEESKGNESQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 12679 - protein, 155 aa, Triticum aestivum
  unsure (1)..(155): unsure at all Xaa locations
MLIVGVFSYADARRYRLGPNYLMLPVNAPKCVFXNIHYDGALIFMHRDEEVDYYPFRHAPLRHAEPASFPVPARPVVGNWEMTRIXKENDFVQPGERYRSWAPDRQDRFVRRFADALAHPKVSHELRVIWIDFLSKCDKSCGMKVANRLNVKPSM

SEQ ID NO: 12680 - protein, 385 aa, Triticum aestivum
  unsure (1)..(385): unsure at all Xaa locations
MWCYSRLVYLPMCYVYGKRLVGLIRPIILXQKNEFFKLPYSEVDWVCVRNLCATGGEFYPHSLLLDILWTTLNKFVEPVMMHRPGNKLREKTFNHVMQHVHYXHENTPYKSICLVCNVVNMLDXWNEDPNSEAFKLHIPRIYDYLWVAEDGMKMQGYNGSQLWDTAFAVQAIAATDLIEEFAPTLKLAHDYIKNSQVVDDCPGDLSYWYRHISKGAWPFSTADHGWPISDCTAEGLKASLLLSKISPEIVGEPVEVNRLYDAVNCLMSWMNENGGFATYELQRSYAWXLELINPAXETFGDNVIDHPYVECTSPAMQALTAFKNLLPGHRRKEVXDNCINKTANDIEXIQRSDGSWDGSGAVCCTYGTGFGVKGLKSFKYSQKKK

SEQ ID NO: 12681 - protein, 581 aa, Schizosaccharomyces pombe
MSHSDYNFDIEQNAFEKEAPKVSIERKGDVVEEEVIATGEVENYAEPKSRNFLQRFFDDFKPALTTRGDGVALKRKLTSRHMQMISVGGAIGSGLYVGSGSAFADGGPASVIINYILIGIMMIFVIYALGELAIAYPVAGSFNTYATRFIDPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 12682 - protein, 101 aa, Medicago sativa
CDPSGNYGGWKAGAIGANNQAAQSILKQDYKDDITREEAVNLALKVLSKTMDRTSLTSDKLELAEVFLAPSGKVKYQVCSPENLTKLLVKSGVTQPATETR

SEQ ID NO: 12683 - protein, 241 aa, Guillardia theta
MSSIKSGYDLLPTIFTPEGKLLQLEYSSKCINKSNIALGIKCNDGLIIFKEIDSNQYNNDIIECNMIFCLNHYMAMTSSGITGDFRSLCNRLVDENLIEKYRYGLELNSKYLTHLLSRLFHLNSNSWSLRPLACDIILGFIDYSSLEIFFISNQGSIIKTNNISTGSACELINFELESIFKEELSCRKVILKIIKKLSALTRDLQSKYFYVKYFAKKKKKFTDTVSFNFIKEIERYKLYQL

SEQ ID NO: 12684 - protein, 493 aa, Xanthomonas axonopodis pv. citri str. 306
MNALTSATAAATDTPAWHGCIFNGDWVPGRGGSLPIHEPATGALLHEVGKADLSDLAAAIAQAKQAQRAWSATPPRERAAVFHRAAQAMQARSAEAALLIARETGGILPKAQREVDESVVFYQQAAAMPLQASGQMLPTSAGQLSLARRLPLGVIGVISPFNFPLILSLRSVAPALAMGNAVILKPDPRTPYTGGVIIAQVLEQAGLPKGLLHVLHGDAQLGQALVESPDVPMIAFTGSTAAGRCIGEIAGRHLKKVSLELGGNNAVIVLDDADLDKAASAVAFGAYMHQGQICMATGRVLVHRSVAQALTQQLAEKARHLPVGDPVSGTVALGPIIDQRQLQRVVDIVNDSVAAGAVVEAGATHEGLFYAPTVLSNVRPGMRAFDEEVFGPVINITVFDTDDEAAELANQGEYGLAAGILSASVSRALALGEKLHTGLLHINDQTVADEVVNPFGGTGASGNGTSVGGPADWEQYTHWQWLTIKNEVPQYPF

SEQ ID NO: 12685 - protein, 637 aa, Triticum aestivum
  unsure (1)..(637): unsure at all Xaa locations
TREKRRRRKNSIDSAPSELSDLGKKIYPSLAPVVFLLRPPPSHLHPSHNPPASSPLIPLHSAPGAPAASGRRKVPLLPPVKMMRCAVRGGGAHVVIGERRSPSSSSPGSGRSVVRMSEGRGGLCCGGVRSRAADLAGLEMGRPSAGAAGLFRSTRYGRVRATASADPEDIPSDKLQAKSSGSVLPYVGVACLGAILFGYHLGVVNGALEYLSKDLGIAENAVLQGWVVSTTLAGATVGSFTGGALADKLGRTRTFILDAIPLAVCAFLSATSQDVRTMIIGRLLAGIGIGISSALVPLYISEISPTEIRGALGTINQLFICIGILAALVAGLPLAQNPAWWRTMFGISVVPSILLALGMAVSPESPRWLFQQGKISQAEAAIKKLYGKEKVTEVMYDLKASGQGSNEPDASWFDLFSKRYWKIVSVGAALFLLQQLAGINAVXVYYSTSVFRSAGIASDVAASALVGAANVFGTMIASSLMDKQGRKSLLITSFSGMAASMLLLSLSFTWKALAPYSGTLAVVGTVLYVLSFALGAGPVPALLLPEIFASRIRAKAVALSMGMHWVSNFFIGLYFLSVVNKFGISTVYLGFASVCALAVLYIAGNVVETKGRSLEEIERELSPPNKADANAFLVSDQ

SEQ ID NO: 12686 - protein, 336 aa, Neurospora crassa
MFAASRIQTRAFSASARQLTKVSVLGAAGGIGQPLSLLLKLNPRVSELALYDIRGAPGVGADLSHINTKSTVKGYEPTASGLADALKGSEIVLIPAGVPRKPGMTRDDLFNTNASIVRDLAKACAESCPEANILVISNPVNSTVPIVSEIFKKAGVYNPKRLFGVTTLDVVRASRFVSEIKGTDPKDENITVVGGHSGVTIVPLFSQSKHPELSKNEQLIHRVQFGGDEVVKAKDGAGSATLSMAMAGARMAESLLRAAQGEKGVIEPTFVDSPLYKDQGIDFFASKVELGPNGVEKIYPVGPVDEVEQKLLDACLVDLKKNIQKGKDFVAANPGK

SEQ ID NO: 12687 - protein, 325 aa, Zea mays
  unsure (1)..(325): unsure at all Xaa locations
MDSGSRSSGGAGFDDEDGLTTRREVSSSLQDLAVRVDWKGGSCSDGGTNQGPNTPRSKHSATEQRRRSKINDRFQILRELLPHNDQKRDKATFLLEVIEYIRFLQEKAQKYEATFPEWNQENPTMLPWSKGQISGDSPPDPSHFXEMDPPLDLISLGNLMIITTSSAAASGAQDQVETDHMASGCYRSAETTANFTNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 12688 - protein, 533 aa, Glycine max
MEEASPKIFIPNTIQGVSEHVTGQIELLWELVKVPLIVPLLKLGVYICLAMSLMLFMERLYMGIVIILVKLFWKKPEQRYNYKPLQDDVELGSFIFPTVLIQIPMFNEKEVYKVSIGAACGLSWPSDRLVIQVLDDSTDTVIKEMVEQECLRWASKGINITYQIRENRTGYKAGALKEGLKRSYVEHCEYVAIFDADFRPEPDFLRRAIPFLVGNPEIALVQARWRFVNANECLLTRMQEMSLDYHFTVEQEVGSATHAFFGFNGTAGIWRIAAINEAGGWKDRTTVEDMDLAVRASLRGWKFLYLGDLQAKSELPSTLRAFRFQQHRWSCGPANLFRKMVMEIVRNKKVKFWKKVYVIYSFFFVRKIIAHMVTFFFYCVVLPLTILVPEVRVPIWGAVYIPSIITTLNSVGTPRSIHLLFYWILFENAMSLHRTKATFIGLLEAGRANEWVVTEKLGDSVNNKNKSNVTKAIRKSRFKFGERLHLLELGFAAFLFLCGCYDYVHGKNYYFLYLFLQTITFSIVGFGYVGTIV

SEQ ID NO: 12689 - protein, 170 aa, Lactococcus lactis
MGYQHNRSFNKATGAGFIIAMGIVYGDIGTSPLYTMESIVQGQGGLERISETSIIGALSLIIWTLTLITTVKYVWIALKADNNHEGGVFSLFTLVRKYAKWLIIPAMIGGAALLSDGALTPAVTVTSAIEGLRSIPAFHEAFGQQQLPIVIITLAILAILFLIQRFGTSI

SEQ ID NO: 12690 - protein, 534 aa, Triticum aestivum
LAFAECRGPGTRPAELYDLSRIVRFLDTWGIINYLAAGSVHRGLRLASSLIREEQTGELQLASAPLKSIDGLILFDRPKCSARAEDIASVASTSSALEVPNGDTGFAHLDEKIWERLSENFCSYCSQPLPSLHYESQKEADIALCSDCFHDARFVPGHSSLDFQRVDGTKDGSDNDGDSWTHEETLLLLEGLEKYLPGRPPVAEHVGTKSKAQCIHHFIRIPVEDGLLESIEVPEASVSSRVQSNGFSYSIPHGGISGSVPQSSQPGQQLPFVNSANPVRPLVAFLASAVGPRIAASCANAALSVLTRDDSRMCSEGNDVMGQAARPNYDASSSVSPENVKYAAMCGLSAAATKCKLFADQEEREIQRLAATIINHQLKRLELKLKQFAEVETLLLKESEQVERARQNLTAQRVRFMSARFASSGGPMPGGSSSTMASNPMNQASPRPPAMPGSMPPASMQAFYGNNMQGHPAQMAFLQQQQRQQQQQQQQQQMLSFGPRLPLSAIHPGSSSSAAPSIMFNTGMPRWLHFWPLQ

SEQ ID NO: 12691 - protein, 457 aa, Rhodococcus sp. DK17
MSYYATTSPLTGQRVQEFPRATDHEISDALTSSDAAYRQWRTSSLEERADVLRALAKLWHERADELAPILTLEMGKPIPQARGEVALCANIFEYYAEHGPTFMEDEVLEIAGGGEAIVRTEPIGPLVGIMPWNFPYYQVVRFAAPNIMLGNTLLLKHSRNCPQSALAIETLFVEAGLPEGVYVNVFADNAQVARMVADPRVRGVSLTGSERAGSAVGEIAGRHMKKFVLELGGSDPFIVLDDTDLDTTVAAAVNNRMANAGQACTASKRLIVLDDVYDRFLDKFTEAMRNIVPGDPTDPATTFGPLSSRSCVDEIAEQVDDALAKGAKLLTGGCRGEGPGAFYEATVLAGVTPQMRVYSEELFGPVAVVYKVATEAEAIALANESPFGLAAAIFTSDRNQARRVAEDLEVGMAWINGTSKSAPDLPFGGVKRSGVGRELGRYGFNEFANKKLVRTVR

SEQ ID NO: 12692 - protein, 454 aa, Kappaphycus cottonii
VKDTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 12693 - protein, 388 aa, Synechocystis sp. PCC 6803
MKAMILAAGKGTRVRPITHTIPKPMIPILQKPVMEFLLELLRQHGFDQIMVNVSHLAEEIESYFRDGQRFGVQIAYSFEGNIVDGDLVGKALGSAGGLKKIQEFNPFFDDTFVVLCGDALIDLDLTTAVKLHREKGAIATIITKTVPQELVSSYGVVVTDDNGKILTFQEKPAVEEALSTEINTGIYIFEPEVIDYIPSGQEYDLGGDLFPKLVDSGLPFYAVNMDFEWVDIGKVPDYWQAIRGVLSREIKNVQIPGIEVRPGVYTGINVAANWDNIEIEGPVYIGGMTRIEDGVKIIGPSMIGPSCLICQGAVVDNSVIFEYSRLGPGARLVDKLVFGRYCVDKTGAAIDVQAAALDWLITDARHAAVQYRQEYPSQREISKLLQPE

SEQ ID NO: 12694 - protein, 546 aa, Escherichia coli O157:H7 EDL933
MTPGEVRRLYFIIRTFLSYGLDELIPKMRITLPLRLWRYSLFWMPNRHKDKLLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVAALEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 12695 - protein, 435 aa, GIBBERELLA ZEAE PH-1
MRVYRVLVSSYHNIVPVSFKTLIKIHLREGLFMVWVNDLATIDVMQLEIDPSLGKYPISGYSSVRREGVIDCFLALDLVHINQCCSHAEAAHVNLSTNIKEFNAPYSVSEVDKPKPKPHQLLIQIKAGGFCHTDCMALAGEFGSKLPFIGSHEPTGVVVEVGSEVEGFTEGDRVGCLNFDSCCGKCPDCKAGKPIYCDAPLMKGLTADGAWAEYMVSDARFAVKLPDALKFPTAACMMCAGATIYGGIKNAKVPAGGSIGIIGIGGLGHIGTQLAKAMGYQVAAIDAKQDTLDLVSSYTLKPDVCILASDPLEYSMKKITDVVKSDYPGLDAVIIATDAPPAFDLAAQLTRKHGTMVLLGQPEKGITLSYQNIIFRDIKLVGSLLADRPVLEELLKLVVEHDIQVKIKEWKIEDAEKMRQEYLTGKNSGKNVIVF

SEQ ID NO: 12696 - protein, 471 aa, Burkholderia fungorum
MHYWRPSPMSLFRKKSVEHMIAASAQNAGLKKALGALDLTFLGVGAIIGTGIFVLTGTGAVQAGPALMISFLIAALACGFAALAYAEFASTIPVAGSIYTYSYATLGELAAWIIGWDLMLEYGLATSAVSVGWSGYLQSLLSGFGVSLPVALTAAPGALPGHDTLFNLPAFLVMMAITALLSFGVRESARINNIMVAIKVIVVLLVICVGVFHVTPANWHPFMPNGWNGVFGAAAVMFFAFIGFDSVSSAAEEVKNPKRDLPIGIIASLGVCAVLYVAVAAVVTGIVPSAQFANISHPVSYALQVAGQKWVAGFIDLGAVLGMLTVILVMAYGQTRVIFAMSRDGLLPARLSRVHPRFATPFFTTWLVGIFFGLIGAVVPLNVLAELINIGTLAAFSMVSIAVLVLRKTHPELPRAFRCPGVPVVPVLAVASCLFLMINLQAVTWVAFVVWLLVGMVVYFGYSRRHSRLSS

SEQ ID NO: 12697 - protein, 501 aa, ASPERGILLUS NIDULANS FGSC A4
MATAVSLTAPNGHKYEQPIGLFINNEFVASKSGEKFATVNPSDEEEITQVYAAGEEDIDIAVKAARKALKDPSWKLLTATDRGNLMLKLADLIDQNKETLAVIETWDNGKPYQVSLNDDLSEVVNTIRYCAGWADKIHGQTISTTPAKFAYTLRQPIGVVGQIIPWNFPLAMAAWKLGPALACGNTVVLKPAEQTPLSILYLAKFIKEAGFPPGVVNIVNGLGRVAGSALVTHPGVDKVAFTGSTMTGKEIMKMAAGTMKNVTLETGGKSPLLVFDDADLEQAAKWAHIGIMYNQGQVCTATSRILVHEKVHDEFIRLFREAVATTSKVGDPFSDDTFQGPQVTKAQYERVLSYIESGKQEGATLVDGGVPYKNVKDGKGFFIAPTIFTNVKDNMRIYREEVFGPFVAIARFSTEEEAIDRANDTTYGLGAAVFTKDIERAHRVASEIEAGMVWINSSNDSDFRVPFGGVKQSGIGRELGEAGLEAYTQIKAVHVNMGTKL

SEQ ID NO: 12698 - protein, 763 aa, Glycine max
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQMEIIRYLYNHQNEDGGWGLHIESHSTMFGSALSYIALRILGEGPEDGEDRAMARGRKWILDHGGLEAIPSWGKFWVTVLGVRLESGCNPLPPEIWLLPKYAPIHPGKMLCYCRLVYMPMSYLFGKRFVGPITGLIISLREEMYNQPYDQIDWNNARSTVAKEDLYYPHPLIQDMLWASLHHVAEPLLNCWPFSMLREKALEVAIDHIRYEDENSGYLCIGSVEKVLCLIARWVEDPNSEAYKLHLARIPDYFWLAEDGLKIQSLGSQLWDATLAIQAIISCDLSEEYGPTLRKAHHFVKASQVLENPSGNFKAMHRHISKGAWTFSMQDQGWQVSDCTAEGLKAALLLSQMSPDLIGEKMEDERFYDAVDVILSLQSGNGGFPAWEPQRAYRWLEKFNPTEIFKDTLIEMEYVECTSSALQGLALFRKLYPKHRRKEVDLCISKAIRYIEKTQNPDGSWFGCWGICYTYGTLFSVKGLTDCGKNYRNSPALRKACKFLLSKQLPNGGWGESYLSSQNKVYTNLKGNRANLVQTSWALMSLIDAGQVEIDPTPVERGIRLLINSQMEDGDFPQQEITGVFMRNCTLNYSSYRNIFLIWALGEYRRRVFTHKSQILSST

SEQ ID NO: 12699 - protein, 272 aa, Oryza sativa (indica cultivar-group)
MGRRACCAKEGMKRGAWTSKEDDVLASYIKSHGEGKWREVRQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 12700 - protein, 519 aa, Ipomoea quamoclit
MATLTLILCTLLFAIFLYFLILRVKQRYPLPLPPGPKPWPVLGNLPHLGEKPHQSIAAMAQKYGPLMHLRLGFVDVVVAASAAVAAQFLKVHDANFSSRPPNSGAEHIAYNYQDLVFAPYGPRWRMLRKITSVHLFSAKALDDFSHVRQEEVATLTRSLASAGKTPVKLGQLLNVCTTNALARVMLGRKVFNDGSSKSDPKAEEFKSMVEEMMVLAGSFNLGDFIPVLGWFDLQGIVGKMKKLHARFDAFLNAILEEHKFVNNQHTTSSKDVDFLSTLLRLRDSGADMDGEEGKLTDTEIKALLLNLFTAGTDTSSSTVEWAFAELLRNPKILSQAQQELDLVVGTNRLVTESDLTQLPFLQAIVKETFRLHPSTPLSLPRIGAESCEINGYFIPKGATLLVNVWAIARDPNAWTNPLQFNPNRFLPGGEKTNVDIKGNDFEVIPFGAGRRICSGMSLGIRMVHLLIATLVHAFDWDLVNGQSVETLNMEESYGLTLQRAVPLMLHPKPRLQPHLYTLN

SEQ ID NO: 12701 - protein, 106 aa, Triticum aestivum
AGRVSEKNCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 12702 - protein, 258 aa, Streptomyces coelicolor A3(2)
MTTRTPLMAGNWKMNLNHLEAIAHVQKLAFALADKDYDAVEVAVLAPFTDLRSVQTLVDGDKLKIKYGAQDISAHDGGAYTGEISGPMLAKLKCTYVAVGHSERRQYHAETDEIVNAKVKAAYKHGLTPILCVGEELDVREAGNHVEHTLAQVEGGLKDLAAEQAESVVIAYEPVWAIGTGKVCGADDAQEVCAAIRGKLAELYSQELADKVRIQYGGSVKSGNVAEIMAKPDIDGALVGGASLDSDEFVKIVRFRDQ

SEQ ID NO: 12703 - protein, 483 aa, Acinetobacter sp. ADP1
MQHVQLLIDGQSVDAANQATFERISPIDGHVASVAAAATLEDVDRALESASRAFQIWSKVSPTERRLRLLKAADLMDQNTEKFIEIGMRETGSTATWYGFNVHLAANMLREAAAMTTQIDGSLIPSDVPGNLAMGIRVPCGVVVGIAPWNAPVILPTRALAMPLACGNTVVLKASEACPATHRLIGAILNEAGLGEGVVNVITHAPQDAPQVVERLIEHPAVKRINFTGSTKVGKIIAETAAKHLKPVLLELGGKAPVVILNDADLDEAVNAVAFGAFFNQGQICMSTERVLVQDGIADRFIEKLIQKTASLKAGNPTQQGSMLGVLESRRAAERIQHLLEDAQQKGANLPLGIQIQDTLMQPTLVLDIQPEMLLYREESFGPVCTVQRFASIEDGVRLANDSEFGLSSAVFSQNFGLAMDVAKQIDSGICHINGATVHDEAQMPFGGTKSSGYGRFGSKASIAEFTELRWITVQTQPRHYPI

SEQ ID NO: 12704 - protein, 348 aa, Kluyveromyces marxianus
MSIPTTQKGVIFYENGGQLYYKDIPVPKPKSNELLINVKYSGVCHTDLHAWKGDWPLDTKLPLVGGHEGAGVVVAMGDNVKGWKIGDLAGIKWLNGSCMNCEECELSNESNCPDADLSGYTHDGSFQQYATADAVQAAHIPAGTDLAQVAPILCAGVTVYKALKTAEMKAGDWVAISGAAGGLGSLAVQYAKAMGFRVLGIDGGEGKEELFKSLGGEVFIDFTKSKDIVGEVIKATNGGAHGVINVSVSEKAIESSIEYCRSNGTVVLVGLPKDAKCKSDVFNQVVKSIHIVGSYVGNRADTREALDFFCRGLVNAPIKVVGLSTLPEIYEKMEQGKVLGRYVVDTSK

SEQ ID NO: 12705 - protein, 124 aa, Glycine max
MASSMISSPAVTTVNRAGAGMVAPFTGLKSMAGFPTRKTNNDITSIASNGGRVQCMQVWPPIGKKKFETLSYLPDLDDAQLAKEVEYLLKKGWIPCLEYEYEHGYVYREHNRSTIYYDRRYLTM

SEQ ID NO: 12706 - protein, 457 aa, Rhodophyllis membranacea
DYVIKDTDILALFRVSPQPGVDPIEASAAVAGESSTATWTVVWTDLLTACDLYRAKAYKVDAVPNTTDQYFAFISYDIDLLEEGSIPNLTASIIGNVFGFKAVKALRLEDMRIPVAYLKTFQGPATGVISERERMDKFGRPFLGATVKPKLGLSGKNYGRVVYEGLKGGLDFLKDDENINSQPFMRWKERYLYAMEGVNRSVAATGEVKGHYLNVTSATQEEMYERAEFAKQLGSIIIMIDLVIGYTSIQTMGIWARKNDMILHLHRAGNSTYSRQKIHGMNFRVICKWMRMAGVDHIHAGTVVGKLEGDPVMIRGFYNTLLLPYLKVNLPQGIFFEQDWASLRKVTPVASGGIHCGQMHQLLDYLGVDVVLQFGGGTIGHPDGIQAGATANRVALESMVIARNEGRNYVAEGPQILQDAAKSCGPLQTALDLWKDITFNYTSTDTADFVETPTANV

SEQ ID NO: 12707 - protein, 463 aa, Bacillus subtilis subsp. subtilis str. 168
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 12708 - protein, 475 aa, Meristiella gelidium
ERYESGVIPYAKMGYWDPEYVVKETDVLALFRVSPQPGVDPIEASAAVAGESSTATWTVVWTDLLPACDLYRAKAYKVDAVPNTSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITLNYTSTDTADFVETPTANV

SEQ ID NO: 12709 - protein, 360 aa, Saccharomyces cerevisiae
MLNRTIAKRTLATAAQAERTLPKKYGGRFTVTLIPGDGVGKEITDSVRTIFEAENIPIDWETINIKQTDHKEGVYEAVESLKRNKIGLKGLWHTPADQTGHGSLNVALRKQLDIYANVALFKSLKGVKTRIPDIDLIVIRENTEGEFSGLEHESVPGVVESLKVMTRPKTERIARFAFDFAKKYNRKSVTAVHKANIMKLGDGLFRNIITEIGQKEYPDIDVSSIIVDNASMQAVAKPHQFDVLVTPSMYGTILGNIGAALIGGPGLVAGANFGRDYAVFEPGSRHVGLDIKGQNVANPTAMILSSTLMLNHLGLNEYATRISKAVHETIAEGKHTTRDIGGSSSTTDFTNEIINKLSTM

SEQ ID NO: 12710 - protein, 223 aa, Vibrio parahaemolyticus RIMD 2210633
MKDFLIAPSILSADFARLGEDVEKVLAAGADVVHFDVMDNHYVPNLTFGAPVCKALRDYGITAPIDVHLMVKPVDRIIPDFAKAGASMITFHVEASDHVDRTLQLIKEHGCKAGVVLNPATPLAHLEFIMDKVDLILLMSVNPGFGGQSFIPHTLDKLRAVRKMIDESGRDIRLEIDGGVKVDNIREIAEAGADMFVAGSAIFGQLDYKQVIDQMRTELAQVE

SEQ ID NO: 12711 - protein, 444 aa, Bacillus subtilis subsp. subtilis str. 168
MAKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 12712 - protein, 436 aa, Streptomyces avermitilis MA-4680
MAHRRDRGLLGIWGDLVLTSVFIAAVSLALFWMAAFTLWWQMHAWRTPEVLASTRFSRPDGGEGLSFSLLLPARHEQAVLDHTIQRLLESSHTDFEIIVIVGHDDPETTEVARKAAARDERVRVVVDTHEKKNKPKAMNTALPHCRGDVVGVFDAEDQVHPELLAHVDHAFRSTGADVVQGGVQLINFNSSWYSLRNCLEYFFWFRSRLHLHAQKGFIPLGGNTVFVRTDVLKEADGWDPDCLAEDCDLGVRLSSVGKKVVVAYDSDMVTREETPGSLMSLLKQRTRWNQGFLQVYRKKDWKQLPGFGQRLLARYTLMTPFLQAISGVIIPLNAAVALFLDVPVGIAFITFLPAVTAFVTFVFEVVGLHDFGKQYGLRVRSVHYLKLIVGGPFYQVLLAGAAIRAVWREQRGRNDWELTSHVGAHLTEVIREDVPA

SEQ ID NO: 12713 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFISPKPTGF

SEQ ID NO: 12714 - protein, 285 aa, Xylella fastidiosa Ann-1
MKFAAVLLFIFIWFSFGYLPLAHMVWSTPGFMLSKGALDFAGGTVVHINAGIAGLVGAYFVGKRIGFGQVAVKPHNVPMTFTGAALLWVGWFGFNAGSALEANSIAALAFINTMLATAAAILVWSLLEKMTKGKFSALGVASGMIAGLVGVTPAAGTVGPFGAITIGAVAAVCCIWGITGLKRLLKVDDTLDVFGVHGIGGIVGAILTGVFTDKALGGQGYAEGMTMSNQVMIQAMGVGISIVWIGIVSLVGFLIVKLLFGLRVSEEAEREGLDITSHGESAYES

SEQ ID NO: 12715 - protein, 386 aa, Bifidobacterium longum DJO10A
MSSIPANLPLRNDLIGEEPYGAPQLDVPVCLNVNENPYAPAPAVCDTIAKRVREIAPTLNRYPDREHIELRQAFSDYLARESGTRLDVDELWGANGSNEIMLQLFQAFGGPGRTALGADPTYSMYPEYARDTFTGWKLAHRNADFTLNVDKVLEAIAEVKPSMVLLTSPNNPTGTPLPMEDIERILAACETAEVVGAGEGVHPILVIDEAYVEFRKPGTPSAVSLIKDHPNLAVSRTMSKAFAFAGARVGYLAASKGIIDCVRIVRMPYHLSAVTQAAALAAFEHTDEQLSRVEHLRETREATAAWLKEQTYKDQPLEVAESGSNFLLFGGHFDKREAIFDELLKRGVLIRVVGPDGWLRVCMGTDEEMETFRNALVEVLRIVEAA

SEQ ID NO: 12716 - protein, 340 aa, Streptococcus pneumoniae R6
MTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPLYGIGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 12717 - protein, 245 aa, Zea luxurians
SIRNNPVQNKLMNGEDPINNNHAQTAGGLGVRLATSSSSRDPSPSDEDMDGEVEILGFKMPTEERMRKRKESNRESARRSRYRKAAHLKELEDQVAQLKAENSCLLRRIAALNQKYNDANVDNRVLRADMETLRAKVKMGEDSLKRVIEMSSSVPFSMPISAPTPSSDAPVPVPVPPPIRDSIVGYFSATAADDDASVGNGFLRLQAQEPAPMVVGATLSATEMNRVAAATHCAGAMELIQTAMG

SEQ ID NO: 12718 - protein, 280 aa, Zea mays
PAGTPSVNRQIDEIREKLEEERSLPETRWVEIFTGPRMMYRTLLGITLQAGQQLTGINFFFYFGTTVFASTGLKDSYVTQLILGSVNCACTFGGLYVVQKCGRRISLMIGAAWMMMCFFIYAFVGHFALDRADPLNTPAAGTVLVTFSCLAIVAFATTWGPLVWHVNAELYPIRYRSVCMGIATASNWFWNFMISFFTRFITDDIDYFYGLIFAGCCAALVLVVFFFVIESKDRTLEEIDTMYVQHVNPITSSRWTPNKQHQNEVGEISDVRSHTQNSEK

SEQ ID NO: 12719 - protein, 211 aa, ASPERGILLUS NIDULANS FGSC A4
MPATPAATPGASAPGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSGKLPTFDIRTPANFGTDFRKV

SEQ ID NO: 12720 - protein, 267 aa, Oryza sativa
  unsure (1)..(267): unsure at all Xaa locations
MWNFASSAWGSGLGKKNTPNCTPSNGDCSDDEASSCTSREEGLECPICWESFNIVENVPYVLWCGHTMCKNCILGLQWAIIKVPTVPIQLPFFVSCPWCNLLSLRIIYKGNLAFPRKNYFLLWMVEGMNGERARSRSAIHSEQQTTXALSSSRASGNERYSNPIRRPLPPPVETQSPSVNHANHGVPIXECXKVQASLRKSLALXGYLTGKFPLGVIFLLIVLYAIPASAAVLLLYILITVLFALPSFLILYFAYPSLDWLVREIFA

SEQ ID NO: 12721 - protein, 492 aa, Xylella fastidiosa 9a5c
MHSNSCHLSDMKNGFFAMLKSLFYTLCILIALALLAGGNAIGRAEAQVQTNPLPSEQVTTELLMSEAAPSDAAAIPKTTPTPVVDKGDVAWMLTSTLLVLLMVLPGLALFYGGMLRSKNVLSIMVQIGVVFSLIAILWVLYGYSLAFADGDMFIGTFNKAFLYGVDTATLADTFSKGFKLPEYLYVAFQLTFAGITGVLIVGAFAERVKFAAVLLFIFIWFSFGYLPLAHMVWSTPGFLLSKGALDFAGGTVVHINAGIAGLVGAYFVGKRFGFGQVAVKPHNVPMTFTGAALLWVGWFGFNAGSALEANSIAALAFINTMLATAAAILVWSLLEKMTKGKFSALGVASGMIAGLVGITPAAGTVGPFGAIAIGAVAAVCCIWGITGLKRLLKVDDTLDVFGVHGIGGIVGAILTGVFTDKALGGQGYAEGMTMSNQVMIQAMGVGISIVWIGIVSLVGFLIVKLLFGLRVSEEAEREGLDITSHGESAYES

SEQ ID NO: 12722 - protein, 392 aa, Zea mays
  unsure (1)..(392): unsure at all Xaa locations
MATGGDKRAALLRQITEEGGFAFVASAEKAAAGDLRAAEAAREMAWEQLHSAPRAEVGAAWRDAYALACLHVAGLRAAVGDRRAALRALDMGLIMGGDLLRAELDAAVAGLGHGDAGAGAGADGDVQRWEEGIAGGRDLADVLQLLPVNSLSCKQIERRSCISLEAFIRDYFLCESPVILSGCIDHWPARKKWKDIKYLESVAGDRTIPVQVGKNYACTELKQELITFSQFLERMWSSDSANLAYIAQHQLFDQIKELHEDIAVPEYCSAGGGKLQSLNAWFGPHGTITPLHHDPHHNLFAQVLGRKYVRLYPASTSXGLYPNTESMLSNTSEVDLDNTDGKEYPETAALEFVDCVLEEGDLLYIPPKWWRYVRSLSISFSVSFRWRTSQLP

SEQ ID NO: 12723 - protein, 669 aa, Ralstonia metallidurans
MNQAATITRPQDETLTTSARRPAQPALPDPLDAGIAHVVESLLAQQQSDGHWVYELEADATIPAEYILMVHYLGETPDLVLEGKIANYLRRIQNADGGWPLFHAGASDISASVKGYFALKMAGDNPEAEHMRRARAAIHAMGGAEASNVFTRTLLALYGVMPWQAVPMMPVEIMLLPEWFPFHLSKVSYWARTVIVPLLVLNSLRPQARNPRKIGIDELFVRPCQATRLPRRAPHQSPLWVGVFRTLDAVVRMAEPLFPRGLRQRAIERAREFTVERLNGEDGLGAIFPAMVNSVLMFDVLGVPESDPNRAIARRSIDKLLVIKDDEAYCQPCLSPVWDTSLAAHALLEVGEPRTIAAAARGLDWLLPLQELELRGDWTVRRPNVRPGGWAFQYANPHYPDVDDTAVVAAAMDRVDKGDRSNRYDEAVSRACEWIVGMQSSNGGWGAFEPENTHLYLNNIPFADHGALLDPPTADVSARCLAMLCQLGQMPANSEPAARALRYLLDEQEADGSWFGRWGTNYIYGTWSALCGLNAAGIGTDAPEMTRAAQWLLSIQNEDGGWGESGDSYKLEYRGYEKAPSTASQTAWAMLGLMAAGAGDHPALVRGVEYLLRTQASHGFWDEPYFTAVGFPRVFYLRYHGYSRFFPLWALARFRNLLRDGNRAISWGL

SEQ ID NO: 12724 - protein, 484 aa, Rhodococcus erythropolis
MQALTSSVPLVIGDQLTPSSTGATFDSINPADGSHLASVAEATAADVARAVEAAKAAARTWQRMRPAQRTRLMFRYAALIEEHKTELAQLQSRDMGKPIRESLGIDLPIMIETLEYFAGLVTKIEGRTTPAPGRFLNYTLREPIGVVGAITPWNFPAVQAVWKIAPALAMGNAIVLKPAQLAPLVPVALGELALEAGLPPGLVNVLPGRGSVAGNALVQHPSVGKVTFTGSTEVGQQIGRMAADRLITASLELGGKSALVAFGDSSPKAVAAVVFQAMYSNQGETCTAPSRLLVERPIYDEVVELVQARVEAARVGDPLDPDTEIGPLISAEQRESVHSYVVSGTEEGATLISGGDQSPTGAPEQGFYYRPTLFSGVTADMRIAREEIFGPVLSVLPFEGEEEAITLANDTVFGLAAGVFTRDVGRALRFAQTLDAGNVWINSWGVLNPASPYRGFGQSGYGSDLGQAAIESFTKEKSIWARLD

SEQ ID NO: 12725 - protein, 534 aa, Oryza sativa (indica cultivar-group)
MGGGGGEQQQLEVLHALNVAKTQWYHFTAIVVAGMGFFTDAYDLFCISLVTKLLGRIYYRVDGSPSPGTLPPHVSACVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVATNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVTLIEVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 12726 - protein, 99 aa, Zea mays
  unsure (1)..(99): unsure at all Xaa locations
SREPIEDPFDQDDWSSYAKLTDDIGQKSXIVGEDLLVTSPPRVARARSERTGSALVLKVNQIGAVSDSTEIVRTPTRPVWGVMVCHTSGETXDTFIADL

SEQ ID NO: 12727 - protein, 223 aa, Mycobacterium tuberculosis H37Rv
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYRAYGAATLEILAEGIEVAGRRVVIIDDVLATGGTIGATRRLLERGGANVAGAAVVVELAGLSGRAALAPLPVHSLSRL

SEQ ID NO: 12728 - protein, 349 aa, Haemophilus influenzae Rd
MKLTKLALCTLFGLGVSIANAADLPNITILATGGTIAGSGQSSVNSAYKAGQLSIDTLIEAVPEMKNIANIKGEQIVKIGSQDMNDEVWLKLAKAINAQCKSTDGFVITHGTDTMEETAYFLDLTVKCEKPVVLVGAMRPATEKSADGPLNLYNAVVVAADKKSSGRGVLVAMNNEVLGARDVTKTSTTAVQTFHSPNYGSLGYIHNSKVDYERSPESKHTINTPFNVEKLDSLPKVGIIYAYSNAPVEPLNALLNAGYQGIVSAGVGNGNVNAAHLDRLEKAAKDSVVVVRSSRVPTGYTTRDAEVDDSKYGFVASGTLNPQKARVLLQLALTQTKDPKVIQQYFEDF

SEQ ID NO: 12729 - protein, 165 aa, Populus alba
LTKKFINLIKHAEDGILDLNKAAETLEVQKRRIYDITNVLEGIGLIEKKLKNRIQWKGLDVSRPGEADDNNVATLQAEVENLTMEERRLDEQTREMQERLRDLSEDENNQKWLFVTEEDIKSLPGFQNETLIAIKAPHGTTLEVPDPDEAVDYPQRRYRILLRST

SEQ ID NO: 12730 - protein, 480 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKRVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 12731 - protein, 613 aa, Bradyrhizobium japonicum USDA 110
MTPPPASAWTRSKPPLLRFLDTCLNEFSAETSGAVADYIPELGNADPAYFGISLATLDGHVYEVGDSRVPFTIQSMSKPFVFALALDLLGAGRVESAIGVEPSGDPFNSIRLNSDNHPFNPMVNAGAIACTGLIYDSKGAEAFEQIRLALSRFAGRDLAVDEAVYSSESQTGDRNRAIGYLLKTNAVISDNVAAVLDVYFRQCAVLVTARDIAVMAATLANRGINPVTGEQVMSAYAISRTLSVMTSSGMYDYAGEWIYRIGIPAKSGVGGGILAALPARLGLGSYSPKLDKHGNSVRGIKVCEALSSHYDLHMLNRSDDARNAVIADYDIGKSPSRRVRRAQEREILAAHEQEVRIIELVGTLSLSAVDYVSRRLAGRPRPQFVIFDLHRVTSTTRAGARLVAEAFEELAALNVTVVLSGVRRASKEWNTLREWTAELKNVRDFYLLDTAIEWAEDQIVYRYGGSIDFHETTELAEQPLLEGLSADELAELGAICTIRTYQSGAKILTTGDPADALFFLRSGAVHVTLPDGVRLATLTAGMAFGEMALLEQTRSADVFADMAATAFEAPLKDFERFREQHPRASERIMRNLAQLLADRLIVANAKVDILTST

SEQ ID NO: 12732 - protein, 267 aa, Geobacter metallireducens
MNARRFNHSADRLCMPEVPEELFLDGIEKLVALERDWIPSSEGTSLYIRPTMIGVDPVLGVKPADHYYFYVILSPVGAYYSAGFNPIKIMVEDQYVRSVPGGTGEAKTGGNYACSLKAGLEAKKKGYDQVLWLDGVHRRYIEEVGAMNMLFAYGKTIVTASLTGTILNGVTRDSTLKLAASLGYTIEERLIDVNELMADIRAGKVTEAFGSGTAAVISPVGVLAYKDEVCTVGNGGVGPITQQLYDTLTGIQTGKVPDTFGWTRKIA

SEQ ID NO: 12733 - protein, 336 aa, Streptococcus parauberis
MVVKVGINGFGRIGRLAFRRIQNVEGVEVTRINDLTDPNMLAHLLKYDTTQGRFDGTVEVKDGGFDVNGKFIKVSAEKDPEQIDWATDGVEIVLEATGFFAKKAAAEKHLHENGAKKVVITAPGGDDVKTVVFNTNHDILDGTETVISGASCTTNCLAPMAKALQDNFGVKQGLMTTIHAYTGDQMLLDGPHRGGDLRRARAGANNIVPNSTGAAKAIGLVIPELNGKLDGAAQRVPVPTGSVTELVAVLNKETSVEEINSVMKAAANDSYGYTEDPIVSSDIVGMSFGSLFDATQTKVQTVDGNQLVKVVSWYDNEMSYTAQLDRTLEYFAKIAK

SEQ ID NO: 12734 - protein, 88 aa, Glycine max
MSARLMKKVLNEQHHLPQHVSEEEEEEENDSEPITRSSINPFDLLNDNDSEPEDQGDELMSTNEILTSYDDKEESASLKPTAEVSTSN

SEQ ID NO: 12735 - protein, 337 aa, Zea mays; identical to SEQ ID NO: 2392

SEQ ID NO: 12736 - protein, 340 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 12737 - protein, 337 aa, Agrobacterium tumefaciens str. C58
MSQINILTEKDLRAVVKLDLSAIDCVERAFSALATEAVAMPPILRLDIPEFRGEVDVKTAYVPGFDGFAIKVSPGFFDNPKLGLPSLNGLMILFSARTGLVDAMLLDNGYLTDVRTAAAGAVAARHLAREDASVAAIFGAGMQARLQLEALTLARPIRSARIWARNHDRAEKLASDFAREHGIDVIAMTDPRAALQGADIIVTTTPAETPILLADWLEEGQHLTAMGSDAEHKNEIDPAVFAKARYVADRLSQTRILGELHHAIAAGRVAPDQPFPELGAIIAGKAQGRRSNDDITFADLTGTGVQDTAIANLAFTRAKDAGSGQIIENTVKMGDAA

SEQ ID NO: 12738 - protein, 454 aa, Halobacterium sp. NRC-1
MTNGDSSSSALTDNERAVLDDIEAQGIDFLRLQFTDILGTVKNVSIPAHQAEKAFTEGIYFDGSSIEGFVRIQESDMRLDPDPETFAVLPWRSNGDGGSARLICDVVDREGNAFAGGPRQVLKNVLARADDMGYSVSIGPEPEFFLFEKDDDGNATTTAHDQGGYFDLAPKDLASDIRREIIFTLEAMGFEIEASHHEVARGQHEINFKYDDALTTADNIATFRAVVRAVAEQHDVHATFMPKPIGEINGSGMHSHISLFDEDGENVFADNDDEFNLSETAYQFMGGVLEHAPAFTAVTNPTVNSYKRLVPGYEAPVYIAWSGVNRSALIRVPDAAGVSARFEIRSPDPSCNPYLALAAVIAAGLDGIDTDADPGDAVREDIYEFDEDKRDAYGIDTLPGHLGDAVTALESDPVMQDALGEHVCEKFAEAKRHEYAEYKASVSEWETDRYLEKF

SEQ ID NO: 12739 - protein, 323 aa, Emericella nidulans
MENYQKIEKIGEGTYGVVYKARELTHPNRIVALKKIRLEAEDEGVPSTAIREISLLKEMNDPNIVRLLNIVHADGHKLYLVFEFLDLDLKKYMEALPVSEGGRGRALPDGSTLSRNLGLGDAMVKKFMAQLIEGIRFCHSHRVLHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRILGTPDETIWPGVTSFPDFKPTFPKWKREDIQNVVPGLEEDGLDLLEALLEYDPARRISAKQACMHPYFQHGSSYYSGRARRNGFH

SEQ ID NO: 12740 - protein, 253 aa, Staphylococcus epidermidis ATCC 12228
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 12741 - protein, 199 aa, Tradescantia virginiana
GLVKKAHEISVLCDAELALIIFSPKGKLYEYATDSKMEIILERYERYTYAEKALIASDPDVQGNWCHEYIKLKAKFEALNKSQRHLMGEQLDTLNQKELLQLETKLEGSLKNVRSRKTQLMLDSISELQEKGKSLQEQNTCLEKEILGKQKDKAPKQHVQWEKQNQPPPTSSAPMPFLIGDIHPTPNIRNFQGRTVADA

SEQ ID NO: 12742 - protein, 321 aa, Pseudomonas stutzeri
  unsure (1)..(321): unsure at all Xaa locations
CIGCHTCSITCKYVWTSREGMEYAWFNNVETKPGIGYPREWENQDKWKGGWVRNGDGTINPRIGGKFRVLANIFANPDLPTIDDYYEPFDFDYQNLHTAPISDHQPVARPRSLISGQRMEKIEWGPNWEEILGTEFAKRRKDKNFDKIQADIYGQYENTFMMYLPRLCEHCLNPTCAASCPSGAIYKREEDGIVSIDQEKCRGWRMCISGCPYKKIYFNWKSGKSEKCIFCFPRIEAGMPTVCAETCVARIRYLGVLLYDADRIHEVASTVNEQDLYAKQLEIFLDPFDPKVIEQALNDGVPMSVIEAXQKSPVYKMAVDW

SEQ ID NO: 12743 - protein, 224 aa, Oryza sativa (japonica cultivar-group)
MAAAAVDPMALGLGTSGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQRW

SEQ ID NO: 12744 - protein, 459 aa, Zea mays
  unsure (1)..(459): unsure at all Xaa locations
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKXPSRVVSSRDPLKLPWXELGIDIVIEGTGVFVDGPRAPGKHIQAGXAKKVIITAPXAKGADIPTYVVGVNEGDYDHSVADIISNASCTTNCLAPFVKILDEEFGIVKGTMTTTHSCTGDQRLLXASHRDLRRARAXAALNIVPTXTGAAKAVALVLPQLKGKLNGIAXLRVPTPNVSVVDLVINTVKTGITADDVNAAFRKGRXPGPLQGILEVCDVPLVSVDFRCSDVSCTIDASLXMVMGDDMGQRVVAWXYDNEWGYSQRVVDLAHLVAAKWPGAAAAGSGDPXLEDFCKDNPETDECKVYEA

SEQ ID NO: 12745 - protein, 902 aa, Neurospora crassa
MSDIPSNTSDTSEAKEPVSLSGMIVTLVPILITSAIYLAIFLVLRKSNRRYYAPRTYLGSLRENERSPSLSNGLFSWVKDFWKIPDVYALQHQSLDAYLYIRYLRMAVTICFVGCCITWPVLFPVNATGGNGLKQLDILTYGNINRETRYNRYYAHVFISWIFFGFVMYLIMRECIFYINLRQAFLISPLYSQRISSRTVLFTSVPEPYLDEQRLRKVFGASVKNVWITSETKEVDELVEERDKVAMRLEKAEVKLIKLANQIRRKAMSKGDVNDVDKQAPLDAESGSIAARWVPRNKRPTHRLGPLGLIGKKVDTIDWCREELTRLIPEAEAAQDKYRDGAFKKVPGVFIEFRTQADAEGAAQILAHHRGLHMTPKYIGIRPNEIVWKSLAIPWWQRVIRRYAVYAFITAMIIFWAIPVGVVGIISNVNYLKTISFLTWLDDIPGFILGAVTGLLPSIALSILMSLVPIVIRICAKLSGEPSLSRVELFTQHAYFAFQVIQVFLVATVASSATAVAKQIADNPGSVTKLLSENLPKSSNFYISYFIVQGLSIATSVLTQVVGFFVFNLVYKFLANTPRALYTKWANLSAISWGSTMPVYTNIVVIAIAYATIAPLMLGWATVAMGLFYLAWRYNVLFVTDTQIDTRGLIYPRAIKQLYTGIYLAEICMIGLFGASVAPGPLVLMVIFLIFTILFHISMNAALNPLLYNLPLTLLAEEEGPLLDTPVDSHTAENGLGGEPRNGVSPTTGANYTEKVPSNGTNGAQSRAEDPILGAKEALDASRHQPNHVTGKKPNFLVKFLKPWIYSDYDTLRAYLPRGVQLDPYTEEVERDAYCPPNVTSDVPLLWIPSDANGAGVSRQEVEHTSRVVPITDEGCELDEKGHLVWDREGTRPPIWEEKIYY

SEQ ID NO: 12746 - protein, 309 aa, Arabidopsis thaliana
MKMATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 12747 - protein, 306 aa, Photobacterium profundum
MNKLVVLGSVNADHVLQVASFPRPGETLHGHSYCVIPGGKGANQAVAAARLGADIAFIASVGDDSFGHQMLEAFANEGMNTEAVMVEENMPTGIAMIQVAATGENSICISAEANACLTAERIKPHHALIANANTLLMQLETPIETIEAAATIAKQSGTKVVLNPAPAQPLTDDLLQLVDMITPNETEAELLTGIKVEDMASAQQAADTLHAKGIKCVMITLGSKGVWISQDGKGQQVEGFRVDATDTTGAGDTFNGALLTGLQAGRKMDDAIRFAHAAAAISVTRMGAQTSIPHLSEVERFLTEHS

SEQ ID NO: 12748 - protein, 65 aa, Brassica oleracea
  unsure (1)..(65): unsure at all Xaa locations
IVSKYPDLKGINFDLPHVIEEATXHPGIXHXGGDMXVSVPKGDAIFMKWICHDWSDEHCXKFLKN

SEQ ID NO: 12749 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 12750 - protein, 471 aa, Gelidium canariensis
  unsure (1)..(471): unsure at all Xaa locations
SGVIPYAKMGYWDPDYAVKETDVLALFRVTPQPGVDPVEASTAVAGESSTATWTVVWTDLLTACDLYRAKAYKVEEVPNSSDQYFAXISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLESHLDQNLPQGIFFEQDWASLRKVTPVASGGIHCGQMHQLLDYVGVDVVLQFGGGTIGHPDGIQAGATANRVALEAMVIARNEGRSFVEEGPQILRDAAKTCGPLQTALDLWKDISFNYTSTDTADFVETPTANV

SEQ ID NO: 12751 - protein, 198 aa, Caulobacter crescentus CB15
MILVIDNYDSFTYNLVHYLNELGADTAVYRNDALSVTEALGLKPAAVLLSPGPKAPDQAGICLPLLEAAPADLPILGVCLGHQAIGQAFGGEVIRAKAVMHGKVSKVRHNDKGIFKGLPNPFTATRYHSLAVRREDLPADLEVTAWTDDGEIMGVQHKTRPIFGVQFHPESIATEGGHQMLANFMDLAGVKRDAAIWV

SEQ ID NO: 12752 - protein, 248 aa, Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVHAPEGMAWEAAGHGPNNIQQTRLPSHSEAFFHPLEGNNSSSQIGYTHMGSDNEMNVGNPGQYVNGYIPGWML

SEQ ID NO: 12753 - protein, 159 aa, Frankia sp. FE36
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARIRGKTV

SEQ ID NO: 12754 - protein, 644 aa, GIBBERELLA ZEAE PH-1
MASAKLVGMGFELLKRATDEEETDPEEGDSAQKELFAAWALFISIMLLIVAFFTSYMLQMKKVTAIHETVISIFAGMVVGLVLMIFGGDSIRTMISFDYQIFFNLLLPPIILSSGYELHQANFFRNIGTILTFAFAGTFLSAVVIGFILYLFTLIPGSLEMSFVDAISVGATLSATDPVTILAIFNAYKVDPKLYTIIFGESILNDAIAIVIFETAQKYKKGEAAGLSIISFFEGTGIFLLVFFCSLFIGFLVGVATALLLKFTYLRRTPKIESCLMVLIPYATYFFSHGLHMSGIVSLLFCGITLKHYAYFNMSRRTQLTTKFIFQILSQLSENFIFIYLGLALFTDNHLQFQPPLIIVTILAVCAARWVAVFPLSKAINWFIRYRAGRRGQEVGDELPYNYQAMLYWAGLRGAVGVALAALLTGENSPALRATVLVVVVLTVIIFGGTTARMLEILGIRTGVVEEVDSDDEFDIETFGGGLQVKRSGTGIGYNPRRNGSVALGSLEAGQSASYVSGASSPHTGGRPTSKVRKNSIPERSDLLRHNDDSDIGSDIDVSDLPPPARRSPLPRSNTATPSRVDSAYATPISETPGGQPITASNAIRQLWTSEDPASVFHHLDEDFIKPRLLLQGDSSRGGNGGPS

SEQ ID NO: 12755 - protein, 993 aa, Streptomyces coelicolor A3(2)
MRWLGRPLTAAVAVTAVLSAVPAPPAASPATDPAAAAAETGNTATVFYYTKTKNWDRYNLHYAPDGGSWTEVPGVAMEAACTDWVKRTVPLGSAEGLRATFNNGSGTWDNNGGENYALGTGALTVKDGVVAHSDPCAGGQDPGPTPGGGNRATVYYSTRTLGWTTANIHYRPAGGSWTAVPGVGMRAACAGWWKKDVDLGAATSLTAAFNNGNGVWDNNKGADYTLPAGVTTVADNTVTADADDPCAEEVPDTAAPTVPAGVSARADGVSVVLTWEPSTDDTGVAKYQVTRSGGTGGEVVSDVGSTVFSDTGLEERTTYTYTVRATDAAGNVSAASAAAIATTGTRPPAPAAGRPLATDPRKDPIYFVLTARFNDGDATNNRGGSQHEKSGNAANDDPMFRGDFKGLVNKLDYIKGLGFSAVWITPVVLNRSDYDYHGYHGYDFYKVDPRLESAGASYQDLIDAAHAKGMKIYQDVVYNHSSRWGAKGLFTPTVYGVRDSQWSWYYDEKQPGFEYDGLTVEPKSGKSYYNGDLWSTAEPTGNTCVNWGRPTGAKSPEGYTLYDCQWPSPTSGMFPKALYHNCWIGNWEGEDSRSCWLHEDLADFNTENPQVQNYLIGAYDKYIDMGVDGFRVDTAVHIPRTTWNRRFLPAIQERVAQQHGAEAAKNFFVFGEVAAFVNDKWNRGSVNHSAQFYTWKERKEYSADDAKAALEMYEYEQQQGTGNQPTSANAFLEGNSYHVPDHSRFSGMNVIDMRMHMNFGDASNAFHNGKDSDDSYNDATYNVVYVDSHDYGPNKSSERFSGGTDAWAENMSLMWTFRGIPTLYYGSEIEFQKGRKIDCGPTCPLATTGRAYYGDHLAGDVTASDFSRVDSATGAVATTLAQPLVKHVQRLNQIRRAVPALQMGQYSTDGITGDMAFKRRYTDGGTDSFALVTVSGGAAYDGIPNGTYRDAVTGDTRTVTDGRLTVAAPGKGNLRVYVLNGPGKIGADGPYLK

SEQ ID NO: 12756 - protein, 161 aa, Oryza glaberrima
MEELEGHRGAGRLPPPPPLLPFPKVSVQVYTVPSSSTAASAAAAGGARQAVAPATRDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFL

SEQ ID NO: 12757 - protein, 548 aa, Zea mays
MESEMADAPAAAIPAAAAEPLAAVAEEGEGEAEGEAPAEAAVGSTLTMERVAAAKKFIENHYRSQMKTIQERKERRFKLERQLASSQVPKEQQIDLIKDLERKETEYMRLKRHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIQSIHKHNYIHRDIKPDNLLLDKNGHMKLSDFGLCKPIDCSKLSTLNEDEPMGDDNMRESMDIDSSLSNTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFQGVAWDKLYEMEAAFKPQVNDELDTQNFMKFEELENPPAKTGSGPSRKMMLNSKDLSFVGYTYKNFDAVKAIKISDLQRNSSLTRPSIGSIFGPSGMDSPMEPNGRDTHMHTVSSGDPMIP

SEQ ID NO: 12758 - protein, 584 aa, Brucella suis 1330
MTGAEMVIQALIDQGVESIFGYPGGAVLPIYDELFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 12759 - protein, 767 aa, Betula platyphylla
MWKLKIGAETARGDGGGGGGSETWLRSLNNHLGRQIWEFHPELGTQEELQQIDDARRRFWERRFERRHSSDLLMRIQFAKENPSSANIPQVKIKDTEEVREEAVGMTLRRAINFYSTIQADDGHWPGDYGGPMFLIPGLVITLSITGTLNAFLSKEHQCEICRYLYNHQNEDGGWGLHIEGPSTMFGTALNYITLRLLGEPEDGMGAVEKARKWILDHGGATAITSWGKMWLSVLGVYEWSGNNPLPPEVWLCPYLLPCHPGRMWCHCRMVYLPMSYLYGKRFVGPITSTIQSLRKELYTVPYHEIDWNKARNDCAKEDLYYPHPLVQDILWASLYYAYEPIFMYWPAKRLREKALDTVMQHIHYEDENTRYICIGPVNKVLNMLCCWAEDPNSEAFKLHLPRILDYLWIAEDGMKMQGYNGSQLWDTTFAVQAIISTNIAEEYGQTLRKAHEYIKDSQVLEDCPGDLNFWYRHISKGAWPFSTADHGWPISDCTAEGLKAVILLSQFPSETVGKSVDVKRLYDAVHVILSLQNTDGGFATYELTRSYHWLELINPAETFGDIVIDYPYVECTSAAIQALTLFKKLHPGHRREEIENCIAKAAEFIENIQASDGSWYGSWGVCFTYAGWFGIKGLVAAGRTYKNCSSIHKACDYLLSKELASGGWGESYLSCQDKVYTNLKDNRPHIVNTGWAMLALIDAGQAERDPTPLHRAARILINSQMENGDFPQEEIMGVFNKNCMISYSAYRNIFPIWALGEYRCRVLKAL

SEQ ID NO: 12760 - protein, 520 aa, Glycine max
MGSDKILPSHVVANGHAPLDSGHARLKELGYKQELKRDLSVISNFAFSFSIISVLTGVTTLYNTGLNYGGPVSLVYGWFLASAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGVINSLPISLLSFLGQLAAIWNVLGVFVLMIVIPSVATERASAKFVFTHFNAENGEGINSKPYIFLLGLLMSQYTLTGFDASAHMTEETKDADRNGPKGIISAVGISIVVGWGYILGITFAVTDILYLLSEDNDAGGYAIAQVFYQAFKKRYGHGTGGIICLVIVAVAIFFCGMSSVTSNSRMAYAFSRDGAMPLSSLWHKVNNQEVPIYAVWLSVFISFCMALTSLGSIVAFEAMVSIATIGLYIAYALPIFFRVTLAQKDFVHGPFNLGRYGVIVGWVAVFWVVFISILFSLPVSYPITIETLNYTPVAVGCLLILVVSYWLISGRRWFRGPITNI

SEQ ID NO: 12761 - protein, 126 aa, Zea mays
  unsure (1)..(126): unsure at all Xaa locations
YNHVLQVDYACTPEEVQQHFQACGTVNRVTILTDKFGQPKGFAYVEFLEQEGVQEALNLNESELHGRQIKVAPKRTNVPGMKQRPPRGYNPYHGYPYRSYGAPYFPPYGYGXAPRFRRPMRYRPYF

SEQ ID NO: 12762 - protein, 66 aa, Triticum aestivum
MSAAGEEDKKPAGGEGGGAHINLKVKGQDGNEVFFRIKRSTQLKNLMNAYCDRQAVDMNAIAFLFD

SEQ ID NO: 12763 - protein, 460 aa, Phycodrys sp.
WDPEYVIKETDILALFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSVAATGEVKGHYMNVTAATMEEIYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPELEVNLPLGIFFKQDWASLRKVTPVASGGIHCGQMHQLLDYLGDDVVLQFGGGTIGHPDGIQAGATANRVALESMVIARNEGRPFVEEGLQILRDAAKTCGPLQTALDLWKDITFNYTSTDTADFVETPTANV

SEQ ID NO: 12764 - protein, 460 aa, Mazzaella japonica
WDPDYVVKDTDVLALFRVSPQPGVDPVEASAAVAGESSTATWTVVWTDLLTACDLYRAKAYKVDAVPNTTDQYFAYISYDIDLFEEGSIANLTASIIGNVFGFKALKALRLEDMRLPVAYLKTFQGPATGVICERERMDKLGRSFLGATVKPKLGLSGKNYGRVVYEGLKGGLDFLKDDENINSQPFMRWKERYLYSMEGVNRAIAAAGETKGHYLNVTAATMEQIYERAEFAKQLGSIIVMIDLVIGYTAIQSMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANI

SEQ ID NO: 12765 - protein, 296 aa, Escherichia coli O157:H7 EDL933
MNFFHASQRDALNQSLAEVQGQINVSFEFFPPRTSEMEQTLWNSIDRLSSLKPKFVSVTYGANSGERDRTHSIIKGIKDRTGLEAAPHLTCIDATPDELRTIARDYWNNGIRHIVALRGDLPPGSGKPEMYASDLVTLLKEVADFDISVAAYPEVHPEAKSAQADLLNLKRKVDAGANRAITQFFFDVESYLRFRDRCVSAGIDVEIIPGILPVSNFKQAKKFADMTNVRIPAWMAQMFDGLDDDAETRKLVGANIAMDMVKILSREGVKDFHFYTLNRAEMSYAICHTLGVRPGL

SEQ ID NO: 12766 - protein, 522 aa, Blumeria graminis f. sp. hordei
MGISESFMFPYLQPLLQLGFGIALASGILSLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPLPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMQPATIAWEKR

SEQ ID NO: 12767 - protein, 591 aa, Schizosaccharomyces pombe
MPSSQISHQDPELGQTSSGSSSIKEKAEPQLYAGPIDPARRPDVFQEGFEDVSVTDDDNDNELLRKMGYQPVLHRSFEFFESFAASFASLDVVSGVRLTFSWGISFGGPAAYWSAMLVTGFCSIVTAACLAEICSALPAAGSIYLWAAESAGPRFGRFVSFLVAWWSTTAWTTFVASITQSTANFIFAEVSTFNNPWPTNDSDVKFRAVQWIVAEVLLVFTILLNQVPPRYYKWIFKASMLLMFIDYVMNIIWVPVATSKKPDGFRSAKWVFTETIYDQAGYIKEVDDANGNPIASLSKIVPKGWQWCLSYFATAGVIVGYDASGHIAEETKDASIKAARGIFYSTVTSFIVAFSLAILYLFCCPDLDTFTAILYNDNSPQPFVNFYSYLLGRGGHVVMNVVIILEIFLNGVVSVLACSRLVFAVSRDGVLPFSNWISQVSKTGQPKNAITVIYIVSALLLCTILPSAVAFTSLVSAAGAPSFAAYAVLAFCRLFITRDKFPKGRWSLGWLSKPCLVITLVYNLFALVVNVSPYTYPVTGPSFNYAVVIMGGVSIFAIICTIVIPKSRWVANRYRYESDSEHSASVKELKV

SEQ ID NO: 12768 - protein, 292 aa, Lolium multiflorum
IELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVLSGDAILMKWILHDWSDQHCATLLKNCYDALPAHGKVVLVECILPVNPEAKPSSQGVFHVDMIMLAHNPGGSQRY

SEQ ID NO: 12769 - protein, 506 aa, Ralstonia metallidurans
MRYAHPGTPGAIVSYKPRYGNFIGGEFVPPVKGQYFTNTTPVTGEAIAEFPRSTAEDINLALDAAHAAAGAWGRTAVQDRSLILLKIADRIEQNLELLAVTETWDNGKPVRETLNADIPLAVDHFRYFAGCIRAQEGSAAELNEHTVAYHIHEPLGVVGQIIPWNFPLLMAAWKLAPALAAGNCIVLKPAEQTPLGINVLMELIGDLLPPGVLNVVHGFGKEAGEALATSKRIAKIAFTGSTPVGSHILKCAAENIIPSTVELGGKSPNIYFEDIMQAEPSFIEKAAEGLVLGFFNQGEVCTCPSRALVQESIYNRFMDAVMTKVAAIKRGDPLDTETMVGAQASEQQYNKIRGYLEIAREEGAECLVGGDVEVMPGSLAKGYYIKPTLLKGRNDMRVFQEEIFGPVIAVTTFKDEAEAVRIANDTEYGLGAGLWTRDINRAYRVGRAIQAGRVWTNCYHLYPAHAAFGGYKKSGVGRETHKMMLDHYQQTKNLLVSYDTQPLGFF

SEQ ID NO: 12770 - protein, 815 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRDVRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 12771 - protein, 236 aa, Zea mays
MPATELAAGEAWDRRRELQAFDDTKAGVKGLVDAGVTALPPIFRHSPESLEGITSSNHVAGAIPTVDLSAARREDTVALVRRAAGTVGFFQVVNHGVPAELMAGMLEGVRRFNEGPAEAKQAIYSRDQARKVRFASNFDLFSSAAANWRDTLFFHLAPDPAPSQELPEAVRDVVTEYGKAVTKVALSVLELLSESLGLSSDHLRDMDCAENLNAVCQYYPPCPEPYLTWGTKKHTD

SEQ ID NO: 12772 - protein, 295 aa, Vibrio parahaemolyticus RIMD 2210633
MNILLAMIPAFFWGTTYAVTQFTLPDWPPVLLGALRALPAGLLLLAIKPSLPKKHEWKVLLVLGTINIAFFFGLIFVMALTLPSAISGVGMISVPVFAMLFGWAVYKRQPSAIQGISGAVLIALAWFLFDPSSISLNPIGLGAMLAAIMCIVIGSSVTKSLGTKMHWWTVLTWQLILGGVLLSIAAAVLATINPQPYVHAVQNIDMTNTLGLLWVIVLNTALGYGMYVWLLQRMSVVDFTFGGIANPIAGIVSGLLLLGENFTPLQYSLMVGMIVMSLLPQILTSLRARKEAITV

SEQ ID NO: 12773 - protein, 237 aa, Paenibacillus macerans
MKKKSCFTLVTTFAFSLIFSVSALAGSVFWEPLSYFNPSTWEKADGYSNGGVFNCTWRANNVNFTNDGKLKLGLTSSAYNKFDCAEYRSTNIYGYGLYEVSMKPAKNTGIVSSFFTYTGPAHGTQWDEIDIEFLGKDTTKVQFNYYTNGVGGHEKVISLGFDASKGFHTYAFDWQPGYIKWYVDGVLKHTATANIPSTPGKIMMNLWNGTGVDDWLGSYNGANPLYAEYDWVKYTSN

SEQ ID NO: 12774 - protein, 449 aa, Oryza sativa (japonica cultivar-group)
MATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 12775 - protein, 499 aa, Saccharomyces cerevisiae
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 12776 - protein, 133 aa, Vitis vinifera
VAGKVSDYDRKSELKSFDDSKLGVKGLLDAGLTKIPRMFINEQHKTDMTWGSRESSPESVPIIDFKGMDKDAALRTQIIKKVGEACEKWGFFQVVNHGIPESVLNDMIDGIRRFHEQDAETKKEYYSRDSQKK

SEQ ID NO: 12777 - protein, 163 aa, Triticum aestivum
  unsure (1)..(163): unsure at all Xaa locations
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQXIEDILLKVS

SEQ ID NO: 12778 - protein, 467 aa, Streptococcus pneumoniae R6
MESKMNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIALPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKVPKNATILTGLASAVAAGMFPLASIAAFLNICTLAYLILLAYGLIRLRKEKGMPKAGEFKTPLVPLLPILSIIICLSFMLQYNVNTWIAFLVALLVGSIIYFTYGYKHSTIEE

SEQ ID NO: 12779 - protein, 487 aa, Oryza sativa
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 12780 - protein, 297 aa, Erwinia chrysanthemi
MKLKDFAFYAPCVWGTTYFVTTQFLPADKPLLAALIRALPAGIILILGKTLPPVGWLWRLFVLGALNIGVFFVMLFFAAYRLPGGVVALVGSLQPLIVILLSFLLLTQPVLKKQMVAAVAGGIGIALLISLPKAPLNPAGLVASALATVSMASGLVLTKKWGRPAGMTMLTFTGWQLFCGGLVILPVQMLTEPLPDVVTLTNLAGYFYLAIPGSLLAYFMWFSGIEANSPVMMSMLGFLSPLVALFLGFLFLQQGLSGAQLVGVVFIFSAIIIVQDVSLFSRRKKVKQLEQSDCAVK

SEQ ID NO: 12781 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 12782 - protein, 272 aa, Glycine max
  unsure (1)..(272): unsure at all Xaa locations
MAVESDKVGSDGKVWSFCSMPFWQTTHASSSSSSTTTTIPTTSSMHHSVHHQSQILQSLDRSTHQPSTTVSSVAKSLLPTRRRLRLDPPNKLYFPYEPGKQVRSAIAIKNTCKSHVAFKYQTTAPKSCNMRPPGDILAPGESIIATVFKFVEXPPENNEKPIDQKSXVKFKINELKXKVEMDYVPELFDEQRDHVAEEQILRVIFLDPERPSPALDKLKRQLAEAEAALEARKKPPEETGPRVAGEGLVIDEWKERRERYLARQQVEVVDSV

SEQ ID NO: 12783 - protein, 234 aa, Zea mays
MENGLVDYSPHNPTQIEKLDSASNVILIDNYDSFTWNIYQYLALEGASVTVYRNDQITLEGLIAEKPTQLVISPGPGHPDTDGGISKAAIREFSGKIPVFGVCMGHQCMISVFGGKVDVAGEILHGKTSVLKHDGKGVYHGLPASLDVTRYHSLAGTHPELPDSLEVSSSTNLEQGAKPIIMGCRHKEFTTEGVQFHPESILTKHGRTMFRNFLKLRGGTWKEHDSCKSEPLSI

SEQ ID NO: 12784 - protein, 222 aa, Canavalia lineata
MARQKIKIKKIDNVTARQVTFSKRRRGIFKKAEELSVLCDAEVGLIIFSATGKLFEYPSSSMKDIITKYNQHSHDNNQLGRPQNLQVEQCVDLSKEVAERNQQLRQMKGEDFQGLNLDDLQQLEKTLETGLERVNETKEKRIMDEIVALHKKGLKLEEENKHLKQKMAMLCMGKSSFLVDSDITLQEVVSSESMNVCSCNSGPSLEDDSSDTSLKLGLPFPN

SEQ ID NO: 12785 - protein, 403 aa, Zea mays; identical to SEQ ID NO: 2196

SEQ ID NO: 12786 - protein, 345 aa, Lactococcus lactis subsp. lactis
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLMIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGATMIEKAVTQTFTDGILTKALGGTATTKEMTEAILKNCQ

SEQ ID NO: 12787 - protein, 394 aa, Oryza sativa (japonica cultivar-group); identical to SEQ ID NO: 9468

SEQ ID NO: 12788 - protein, 461 aa, Zea mays
MASFSSLSASSSTSTPSFNLPAKTSAGTGSLSFHRARESQKSRARMVTVRAEAVDTTISPRVNALRPSKTMAITDQATALRQAGVPVIGLAAGEPDFDTPAVIAEAGINAIRDGATRYTPNAGTLELRKAICKKLEEENGLSYSADQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKHPRLLVLSDEIYEHIIYQPAKHTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQTAMGKIKEAMALLRPPVAV

SEQ ID NO: 12789 - protein, 163 aa, Triticum aestivum
MDAPAFHELRRQASSYLTGKIRSARLVLTDVTPTQLMTEEATNGDASLPNAKTMSLIAREAFEIDEYLRISDILHTRLATFDRRQWREPYKALLPLEHLLTHGPRSVALEFQKDREVIRQMATFQHIDERGFNWGLTVKGKSERVLKLLERGPFLEEERERAP

SEQ ID NO: 12790 - protein, 463 aa, Achromobacter xylosoxidans subsp. denitrificans
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGRFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 12791 - protein, 429 aa, Zea mays
MASAGISGSGDDDAGGKLLADRYQKGEVLGEGTYGVVFKAFDTKTGNTVAVKRIWVGKDKKEGVNFTALREIKLLKELKGPNIIELIDCFPYKENLHLVFEFMETDLEALIKDKNIILSPADTKSYLQMLLKGLSFCHKKWVIHRDMKPNNLLIGADGQLKLADFGLARMFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLLPMASDDALDLLSKMLTYDPKARISAQQALEHRYFSSLPAPTRPSQLLRSRWKGDQGNNKMPDLNLQHGPLVLSPPRKLRRVIAHEWMEGMHRADKVDEHPSGMRHTDDMPSQKSSRIPMSVDVGAVFGTRPAPRPTLNSADKSRLKRKLDMDPEFGFAE

SEQ ID NO: 12792 - protein, 341 aa, Oenococcus oeni MCW
MTVKIGINGFGRIGRLAFRRIMELQDKASDIEVVAINDLTTPSMLAYLLKYDTTHGTLNADVSANDDTSTLTVNGKDYHIYSEKDARNLPWVKNDGVEYVLECTGFYTSKEKAQAHIDAGAKRVLISAPAGKIPTIVYGVNQDTLTSSDTIVSAGSCTTQSLAPMARLLQDKFGIEVGTMTTIHAYTSTQMILDGPRSSKKRTNRTAASNTIPHSTGAAKAIGLVVPEVDGKLNGHAQRVAVVDGSVTELTTILSKKVTPEEVNDAFKEYTKGNESFGWNEDEIVSSDIINDTHGAVYDPTQLEVITAGDKQLVKTVSWYDNEYGFTSNMVRTLLHFAKLE

SEQ ID NO: 12793 - protein, 247 aa, Zea mays
PSVRGRVGDIAFYSQNLFQKDIFTSINWIPKANTMSALEEVFRISRAQTLIALCGTVPIGFVVMYAGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 12794 - protein, 157 aa, Triticum aestivum
  unsure (1)..(157): unsure at all Xaa locations
MAPTVMASSATSVAPFQGLKSTAGLPVSRRSNGASLGSVSNGGRIRCMQVWPIEGIKKFETLSYLPPLKHGGLLKAXSDYLIRSKWGALPPIQARLGHLPXEHNASPWGTXDGRYWXMXNCLVXGAPTQQVXNEVXGVKEDTXXYSASRFTSPHASP

SEQ ID NO: 12795 - protein, 88 aa, Glycine max
MLKERRQMMLSQILSAEARERLARIALVKPEKARGVEDFILRAAQMGQITEKVSEERLISLLEQINNQTTRQTKVTIQRRRSVLEDDD

SEQ ID NO: 12796 - protein, 221 aa, Oryza sativa
  unsure (1)..(221): unsure at all Xaa locations
MAGTRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFDNISRWLKELRDHADANIRIMLVGNKTDLKXHLRAVATDDAHKFAEAEGLSYIETSALEATNVEEAFQLILGDIYRAISKKPVASDEGGAGAAGGVKEGKTINVAAGDANSEKKQCCST

SEQ ID NO: 12797 - protein, 74 aa, Phytophthora infestans
MGLLDIVQPGVLNGEDVVKVYKYAQEHNAIFPAVNVTSSSTVNAALQAARDIKSPIIIQTSNGGAFYAGKGIDN

SEQ ID NO: 12798 - protein, 470 aa, Chondracanthus canaliculatus
  unsure (1)..(470): unsure at all Xaa locations
GVIPYAKMGYWDPDYVVKDTDVLALFRVSPQPGVDPVEASAAVAGESSTATWTVVWTDLLTACDLYRAKAYKVDPVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRAIAAAGETKGHYLNVTAATMEEMYERAEFAKELGSIIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMXXXXXXXRDYVSEGPQILQDAAKTCGPLQTALDLWKDITFNYTSTDTADFVETPTANV

SEQ ID NO: 12799 - protein, 492 aa, Neurospora crassa
MRPERQLSVVLGLLLSAAVQVGALTSSEWRKQSIYQVVTDRFARSDLSTSAPCDTSQQVYCGGSWQGLISKLDYIQGMGFTAVWISPIVKQIDGVTKDGSSYHGYWASDIWSLNPSFGTADNLKGLSKALHDRGMYLMVDVVTNHMAYLGCRSCINYQGLNPFSSQSYYHSPCTINYDNQTSIETCWQGSDVVSLPDLKTETDGLRIDSVKHVEKSFWPGFESAAGVFAIGEVFQGDPAYLAPYQSYISGVLDYASYYWIVNAFQSTSGNITALANGMNILKAAAIDLSLYGSFLENHDQARFAHKTSDMAIAFTMLKDGIPIIYQGQEQHYAGSDTPYNREALWLSGFSTNSELYTWIKRLNQLRTHAIKKDDGYLTYRAWPIYSDSHTIAMRKGSSNKQVVGVFTNVGASSSTAVTLSSLASGFSADEPVTDVRYLFLTVSSHFDHQHKFRSSYIDFVGGLGNTTTLGSWNTANAVTLSASKYTSSNPLW

SEQ ID NO: 12800 - protein, 336 aa, Ralstonia eutropha
MTIKVAINGYGRIGRNVLRAHYEGGKRHDIEIVAINDLGNAATNAHLTQYDTVHGRFPGEVSVDGDAFRVNGDRIRVLAQRNPAELPWGELGVDVVMECTGLFTSKEKASAHLRGGAKKVIISAPGGKDVDATIVYGVNHGVLKATDTVISNASCTTNCLAPLVKPLHEKLGLVNGLMTTVHSYTNDQVLTDVYHEDLRRARSATMSMIPTKTGAAAAVGLVMPELDGRLDGFAVRVPTINVSLVDLSFVAARPTTVEEVNGILKAAAEGELKGILDYNTAPLVSVDFNHNPASSTFDATLTKVNGTLVKVSAWYDNEWGFSNRMLDTAVALAHAR

SEQ ID NO: 12801 - protein, 470 aa, Gelidium pusillum
  unsure (1)..(470): unsure at all Xaa locations
GVIPYAKMGYWDPDYVVKETDLLALFRITPQPGVDPVEASAAVAGESSTATWTVVWTDLLTACDLYRAKAYKVEAVLNSSDQYFAYISYDIDLFEEGSIANLTASIIGKVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEXKGHYMNVTAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYNTLLLTHLEVNLPQGIFFEQDWASLRKVTPVASGGIHCGQMHQLLDYLGIDVVLQFGGGTIGHPDGIQAGATANRVALEAIVIARNEGRDYVAEGPQILRDAAKTCGPLQTALDLWKDITFNYASTDTADFVETPTANV

SEQ ID NO: 12802 - protein, 542 aa, Citrus x paradisi
MDQAISSVVRKLQMVNTSDHNSVVSINIFVALPCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFTFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTEPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 12803 - protein, 287 aa, Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 12804 - protein, 493 aa, Azorhizobium caulinodans
MNVKTWSRVGLPTLLAASALALPVLAQTAAPAADAPAAAAAIPINKGDTAWMLVSAALVLMMSVPGLALFYGGLVRTKNMLSVLMQVFYTVSVVGILWVLYGYSLAFTGGSDFVGGFSKAFLAGITPDSGTGTFSVGVNIPEFAFIAFQMTFAMITPALIFGAFAERVKFSAIVLFVPLWVTFIYFPMAHMVWYWAGPDAVDAAAKALAAADAGGKAAAQSALDAVLADAGYIYKLGAIDFAGGTVVHINAGIAAFVGCLIVGKRTGYGKEAFQPHSLTLTLVGAGLLWVGWFGFNAGSNLEANGLTALAMMNTFIATCAAALSWMVVEWLAKGKPSMLGVVSGAVAGLVAVTPMAGFAGIMGSLVSGLIVGVLCFFFCTTVKNAFGYDDSLDVFGVHCIGGIFGAIATGIVVSPALGGTGIFDYTTGKVADYDMATQVIAQVKAVVVTLVWSGVGSAVLYYIVHAVVGLRATVEREREGLDITEHGERAYHS

SEQ ID NO: 12805 - protein, 497 aa, Oryza sativa
MASPPQPGPYMPDLPAVPAWLNKGDTAWQLVAATFVGIQSMPGLVVIYGSIVKKKWAVNSAFMALYAYASTLIVWVLVGFRMAFGDRLLPFWAKAGPALTQDFLVQRAVFPATAHYGSDGTLETPRTEPFYAEAALVLFEFEFAAITLVLLAGSLLGRMNIKAWMAFTPLWLLFSYTVGAFSLWGGGFLYQWGVIDYSGGYVIHLSSGVAGFTAAYWVGPRLKSDRERFSPNNILLMIAGGGLLWLGWAGFNGGAPYAPNVTATVAVLNTNVSAATSLLTWTCLDVIFFGKPSVIGAVQGMMTGLVCITPGAGLVHTWSAMLMGMFAGSVPWFTMMILHKKSTFLMKVDDTLAVFHTHAVAGILGGVLTGLLATPELCALDCPIPNMRGVFYGSGIGQLGKQLGGALFVTVWNLIVTSAILLCIGLFIPLRMSDDQLMIGDDAAHGEEAYALWGDGEKFDVTRPETTRTGGAGGAGREDTMEQRLTNMGARGVTIQL

SEQ ID NO: 12806 - protein, 416 aa, Zea mays
  unsure (1)..(416): unsure at all Xaa locations
MDACEEYIKDIINQWEQRKGKERKGRKFHIAIVSRIGGRTKVASRKFLPCWEGMASEVEDDAAVPGAPLVANGAADVRRRRDQAKAILSKQAVKIATKAEQHERFIFKVTHLLGVLGFGGFCYLLGARPQDVPYVYCLFYVIFVPLRWIYYRYKKWHYYLLDFCYYANTFLLVMILFYPKDEKLFMVCFSFAEGXPLAWALIVWRCSLVFGSFDKLVSVLIHLLPGIVLFTIRWWDPQTFAAMHPEGRDARVTWPYVEDKSYMWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQVERKQQKKLGMKPIEQGSWTQGAPADGTYIG

SEQ ID NO: 12807 - protein, 488 aa, Chordaria chordaeformis
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENFNSQPFMPWKERFLYWMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHNHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDSVGEGPEILRRAATTCGPLKAALDLWKDITFDYTSTDTPDFVEVATESR

SEQ ID NO: 12808 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 12809 - protein, 314 aa, Gymnodinium simplex
RIGRMVFQAICDQGLLGSKLDVVGVVDMSTDAEYFAYQMKYDTVHGRFKHEVKIGAKDELIVNGHKIKCIMASREGPKALNWGELGVEYVIESTGLFVEAEKAQGHIEAGAKKVIISAPGKGSLKTLVMGVNHTEYDKSSMHVVSNASCTTNCLAPVCHVLLKEGIGIEKGLMTTIHAYTATQKTVDGVSAKDWRGGRAAACNIIPSATGAAKAVGEVLPVTKGKLTGMAFRVPTPDVSVVDLTFLAEKDTSIQEIDEKLKAATESYMKGVLSYTDEELVSSDFIHNANSSIHDSKATLQNNLPGEKRFFKVVS

SEQ ID NO: 12810 - protein, 598 aa, Triticum aestivum
AASPAATSVAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNALLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPNGGAFKDMIMEGDGRTSY

SEQ ID NO: 12811 - protein, 338 aa, Chlorobium tepidum TLS
MVLERVVDLLHETQPLVLRELPVPEPGPGEILLRVATCGVCHTELDEIEGRTPPPRFPVIPGHQVIGRVVACGDGVAGIETGSRRGVAWIYSSCGHCDLCRSGNENLCAEFSATGRDADGGYAEYMVAPAAFTYSIPDVFSDAEAAPLLCGGAIGYRSLMLANLKDGQILGLTGFGASGHQVLKLARYLYPKSPVFVFARSEKDCDFARSLGADWAGGTTDNSPSPCDSIIDTTPAWLPVLSALERLRPGGRLVINAIRKESHDSELLAGISYERHLWMEKEIKSVANITRADVSAFLDIAARMGLKPEVRSYPLEEANRVLLDLRHGKARGAAVLIP

SEQ ID NO: 12812 - protein, 483 aa, Zea mays
MRINVCGCRGSTVHLHHLSSSSSPPPLPFHLLPPGDSSSSLPRRSIGPPIDRARGRRFQSGVVSIRSGSLPVWVGAMAAMDASADKNAVFRKLRAKSDNKMCFDCNAKNPTWASVTYGVFLCIDCSAAHRSLGVHVSFVRSTNLDSWTPEQLKMMVYGGNNRAQAFFKQHGWTDGGKIEAKYTSRAADLYRQLLAKDVAKSSTEDGNNSWPSSPVAASQAPNQAAAFPDLKLTEVSKENVSEKKDSEIVRSPRAPTHSFKKPIGAKKPGNKTGGLGARKLTSKPNESLYEQKPEEPAPVLPSSVIESTTTRSKSHTSRFDYVENAPALKNGNSSEGNHMSGHVAPPMSSNFFAEFGMDSGYQKKSTSSSSKVQIEESREARQKFSKAKSISSSQFFGDQASFEKDAQVSLQKFSGSSAISSADLFGHPANNSSVDLSASDLINRISFQATQDLSSLKNMAGETGKKLTSMASNIITDLQDRIL

SEQ ID NO: 12813 - protein, 337 aa, Salmonella typhimurium
FFLFDDIRFGASISGSHVAIDDIEGAWNSSTKYEGGNKGHRPGVKGGYFPVPPVDSAQDIRSEMCLVMEQMGLVVEAHHHEVATAGQNEVRTRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 12814 - protein, 495 aa, Staphylococcus aureus subsp. aureus Mu50
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 12815 - protein, 358 aa, Penicillium marneffei
MGCINSKVEPEDKEAVRINAGIDKQIRSDKKTYDRTVKMLLLGAGESGKSTIIKQMRIIHSGGFPEDERRQNRAVIYSNLVVAFKVLMDIMQTQKIEFEKESNQALGIFLAKTEADVDTDEAFADLEIKEAMTELWSDSGVQKAVARGHEFALHDNLHYFFNSLDRLFTPGWLPDNQDMLHSRLRTTGITETLFELGQLNFRMMDVGGQRSERKKWIHCFEGVQCLLFMVALSGYDQSLLEDQNANQMHEAMMLFESLANGEWFKRKPIMLFLNKMDLFRTKLPLSPINKHFPDYSGSSTDFDTAAKYFADRFRSINRMPDREIYIHYTNATDTTLLKATMDSVQDMIIQKNLHTLIL

SEQ ID NO: 12816 - protein, 109 aa, Glycine max
  unsure (1)..(109): unsure at all Xaa locations
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 12817 - protein, 426 aa, Dechloromonas sp. RCB
MREQTDMRFISHLTRNTFAIILAGGRGTRLKQLTDFRSKPAVPFAGKFRILDFTLSNCVNSGIRKIGVATQYKAHSLIRHIQRGWSFLDGRFDEFIQLLPAQQQIDETQWYQGTADAVYQNLHFLRRYQPDHILVVAGDHIYKMDYGRMLAHHVKHHADMTVACIDVPLDEAREFGVMGVDEQDRVIDFVEKPQNPPAIPGQPDRALASMGIYIFNTKFLFEQLERDAMTKGSNRDFGKDIIPYIVPRYRVFAHRFADSCVGSDNHRPYWRDVGTIDAYWEANMEMTKVTPELNVYDRDWPIWTYQEQIPPAKFVFDDEDRRGTAVDSLIAGGCIISGASVKRSLLFSSVNVHSWASVEDSVVLPDVDIGRHAVLKRCVIDKHCRIPEGMVIGVDPEEDRKRFHVSPKGITLVTAEMLGQGAAEGR

SEQ ID NO: 12818 - protein, 75 aa, Glycine max
  unsure (1)..(75): unsure at all Xaa locations
KKHEGKILQWHAVASWTWDAQDETCGICRMAFDGCCPDCKFPGDECPIIWGACXNHAFHLHCILKWVNSQTSTPL

SEQ ID NO: 12819 - protein, 337 aa, Schizophyllum commune
MAVKVGINGFGRIGRIVLRNALQLGNIEVVAINDPFIALDYMVYMFKYDTVHGRYKGTVEVKDGKLVVDGHAITVFAEKNPADIKWGSAGADYIVESTGVFTTVEKASLHLQGGAKKVVISAPSADAPMFVVGVNLDKYDSKYQVISNASCTTNCLAPLAKVIHDKYGIAEGLMTTVHATTATQKTVDGPSHKDWRGGRSVNNNIIPSSTGAAKAVGKVIPSLNGRLTGLAFRVPTLDVSVVDLVVRLEKEASYDEIVATVKEASEGPLKGILGFTDESVVSTDFTGANESSIFDSKAGIAISKSFVKLIAWYDNEWGYSRRVCDLLVYAAKQDGAL

SEQ ID NO: 12820 - protein, 364 aa, Oceanobacillus iheyensis HTE831
MEEQTIRVQRSETKKEKPQSDQLIFGRSFTDHMFVMDYSDPLGWHNASIVPYQPLSIDPSSMIFHYGQSVFEGLKAFRTESGDIQLFRAEKNLERLNRSNDRLCIPQIDEEFTLKAIKQLISIEKDWVPSAEGTSLYIRPFIISTEAYIGVAPSMNYKLIVILSPVGAYYKEGINPVKIAVEDHYVRTVKGGTGEAKTGGNYASSLKAQEIVAKQGFAQVLWLDGVEKKYIEEVGSMNVFFKINGEVVTPQLNGSILSGVTRSSVIELLKHWGVPVSEKRISIQDLYQAYLDGELEEAFGSGTAAVISPIGQLTWEGKDMIVNNGETGELSKRIYDTITGIQYGHLDDPFQWIQGIEAKSPVKH

SEQ ID NO: 12821 - protein, 308 aa, Neurospora crassa
MTSTSTTTNGDSFTVKAGLAQMLKGGVIMDVTTPAEARIAEEAGACAVMALERIPSDIRAAGGVARMSNPSMIKEIQAAVTIPVMAKARIGHVTECRILEQLGVDYIDESEVLTPADDTYHVQKDQFKAPFVCGCRNLGEALRRIKEGAAMIRTKGEAGTGDVVEAVKHIRTVNAEIAQAKAALASGGELAVAKMAREIGADVELLKKTAELGRLPVVNFAAGGVATPADAALMMEFGCDGVFVGSGIFKDAKTPEHALQRARAVVKAVANWNDYGALVEACIEHGEAMKGISNAGMKPEERMAGRGW

SEQ ID NO: 12822 - protein, 261 aa, Arabidopsis thaliana
SSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEH

SEQ ID NO: 12823 - protein, 679 aa, Glycine max
  unsure (1)..(679): unsure at all Xaa locations
VYYGAGGTLALYSLLCRHANIRTIPNQHRTDEELTTYSRSTIREKSFAAKTKRWLEETPYMKNIILMLALVGTCMVIGDGILTPAISVLSAAGGIKVNHADLSNEVVVLVAVVILGGLFSMQHYGTXKVGWLFAPIVLLWFLLIGGIGIFNICKYGSSVLKAFSPLYIYRYLQREGKDGWLSLGGILLSITGTEALFADLAHFPVSSVQIAFTLLVFPRLLLAYSGQAAYLMHNLDHSQDAFYRSIPDKIYWPVFVVATLAAIVASQATISATFSIIKQALAHGCFPRIKVVHTSKKFLGQIYIPDINWILMILCIAVTAGFKNQSQIGNAYGTAVVLVMLVTTLLMILIMILVWRCHWILVLVFTGLSLIVECTYFSSVLFKVDQGGWVPLAIAGAFLIIMSVWHYGTVKRYEFEMHSKVSMAWILGLGPSLGLVRVPGIGLVYTELASGVPHIFSHFITNLPAIHSVVVFVCVKYLPVYTVPEEERFLVKRIGPKNFHIFRCVARYGYKDLHKKDDDFEKKLFENLFTFVRLESMMEGCSDSDEYSLYGQKIEHPRDGLLHNNGSTVSSNMDLTMSSVDSIVPVRSPHHMNITVRSSGQTSSQTEVDELEFLTTCRDAGVVHILGNTVVRARRESRFYKKIAVDYIYAFLRKICRENCVIFNVPHESLLNVGQIFYV

SEQ ID NO: 12824 - protein, 341 aa, Coxiella burnetii RSA 493
MQDWNQYKELLYKLLRIRMIEEEIVLQYPKGKMRCPTHLSIGQEAIPIMVCENLHNTDLMVSTHRAHAHYLAKGGNLKALIAELHGKVTGATAGRGGSMNLSDLSVGFVASTAIVANTVPIGVGLAFSQKLKKSNVITTIFLGDAAVEEGVVYESLNFAVLKRLPVLFVCENNLYSVNTPLHLRQPANRAIHEMAKGIGAKTQNIDGNDIPTSFHSVCEVMKDLRANGGVWFLEFQTYRFKVHCGPEEETFTDRSKTEFDHWLARDPLSLLQSQLLTAKTVSPEEIDKWRHEIQNEIDEAFTFAESSPYPPPEDRFRYRYADSRNEWLRHQLDKQKDEVLT

SEQ ID NO: 12825 - protein, 181 aa, Zea mays
MGGGKDKHHDEQDKGFHGFPGGGHHYPPAGYPPQQGYPPAGGYPPAGYPPGAYPPGPGGYPPAPGHGGYPPAGYPAPHHSGHSSGGLGGMIAGAAGAAAAAYGTHHVGHASHNPYGHAGPGGFGPGGFGHVGHASHGYGGHGHGKFKHGKHGGKHGGKFKHGKHGKHGMFGGGGGKFKKWK

SEQ ID NO: 12826 - protein, 80 aa, Glycine max
  unsure (1)..(80): unsure at all Xaa locations
KIHTMGGYCDVTFPRRLEGPLYYQGAMXLSYEKEVFAGLLYSMKQPTIVAPKVVSVKIALTRAKVIDKAYTFLSRHILWP

SEQ ID NO: 12827 - protein, 472 aa, Ahnfeltiopsis intermedia
ESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEEMYERAEFAKELGSIIIMIDLVIGYTAIQTMAIWSRKNDMILHLHRAGNSTYSRQKIHGMNFRVICKWMRMAGVDHIHAGTVVGKLEGDPLMIRGFYNTLLLPYLKVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 12828 - protein, 328 aa, Nostoc sp. PCC 7120
MRAMILDAPRQPLRLTELPVPKPNSEQVLIRVHACAVCRTDLHIVDGELTHPKLPLILGHQIVGTIEALGEKVDQFHLGQRVGVPWLGHTCAHCPYCLSGRENLCDYAEFTGYNLDGGYADYTVADHRFCFPLDPSYPDLQAAPLLCGGLIGYRAYNMTGNAEKLGFYGFGSSAHILIQLARYQGRKVFAFTRPGDTVGQEFARQLGANWAGDSDVLPPEPLDAAIIFAPVGKLVPTALRAVAKGGVVVCAGIHMSDIPSFPYSILWEERVLRSVANLTRQDGEEFLTIAPQIPIRTEVNSFPLTQANEALDALRSGKIEGSAVLVMK

SEQ ID NO: 12829 - protein, 485 aa, Ralstonia eutropha
MNAPESVQAKPRKRYDAGVMKYKMGYWDGDYVPKDTDLLALFRITPQDGVDPVEAAAAVAGESSTATWTVVWTDRLTACDMYRAKAYRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKGGLDFMKDDENINSQPFMHWRDRFLFVMDAVNKASAATGEVKGSYLNVTAGTMEEMYRRAEFAKSLGSVIIMVDLIVGWTCIQSMSNWCRQNDMILHLHRAGHGTYTRQKNHGVSFRVIAKWLRLAGVDHMHTGTAVGKLEGDPLTVQGYYNVCRDAYTQTDLTRGLFFDQDWASLRKVMPVASGGIHAGQMHQLIHLFGDDVVLQFGGGTIGHPQGIQAGATANRVALEAMVLARNEGRDILNEGPEILRDAARWCGPLRAALDTWGDISFNYTPTDTSDFAPTASVA

SEQ ID NO: 12830 - protein, 416 aa, Helicobacter pylori J99
MENSTLYIVIAGLWLAVGFGIFLKKLDMPVIIGYICTGTVLAAFFKINDFNLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSHVNLLILKTLISAGIILILLLLPGKKGANLILEQAKDTRLPEIFIGTVLVIVCSAAGLSHFFGFSMSLGAFIVGMAISKSRYKINVQEEFAQLKNLFLALFFITIGMQINVSFFMEKFFVVIFLLILVMSFKTFIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 12831 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASSTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 12832 - protein, 98 aa, Triticum aestivum; identical to SEQ ID NO: 9185

SEQ ID NO: 12833 - protein, 403 aa, Bradyrhizobium japonicum USDA 110
MALMPVSDALAAVLAGAEPLPEEMIPLDEAYHRVLARDVAARRTQPPEAMSAMDGYAVRAADAARVDAQLTMIGEVAAGRPFAGAVSAGEAVRIFTGGVVPAGADAVVIQEDTVAEGKRITIKEAAIAGRHIRPAGVDFREGDVLLRKGTRLTERDLALAAGMNHPDLPIRRRPKVAILATGDELVMPGTTPGPGQIVYSNGYALHALARQEGADTIDLGVAADTLEATTAGIRRARESGADILITIGGASVGDHDLVQQALKAEGIAMAFWKIAMRPGKPMMHGRLGAMGVIGLPGNPVSSYVCGFLFMVPLIRALSGRAVIHHRRERAVLGRDVGANDQREDYLRARLERRDDGMLVALPVNHQDSSLLANLAAAQALLVRAPFAPKAEAGAPCEVLRLPA

SEQ ID NO: 12834 - protein, 337 aa, Brassica rapa
MAGIRLAPEEPETTPQQQARATTDSLASDDDRSIAADSWSIKSEYGSTLDDDQRHADAAEALSSANFRVSSDYSSDKEEPDAEGGQSMLGLQSYWDAAYSDELSNFREHGHTGEVWFGDDVMEIVTSWTKDLCVEISQKETSVSDNGEVNDQADKYLSSWNVLDLGTGNGLLLHQLAKEGFSDLTGTDYSEGAVELAQHLSQRDGFPNIRFMVDDILDTKLERQFKLVMDKGTLDAIGLHPDGPVKRVMYWDSVSKLVAPGGILVITSCNNTKDELLEEVENFNMRKSNLTGDVSSEAASGTDHPPFEYLSHVRTYPTFMFGGSVGSRVATVAFLRK

SEQ ID NO: 12835 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQGSGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFRPERFLKLEGDSSGVVDVRGSHFQLLPFGSGRRMCPGVSLAMQEVPALLGAIIQCFDFHVVGPKGEILKGDDIVINVDERPGLTAPRAHNLVCVPVDRTSGGGPLKIIEC

SEQ ID NO: 12836 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 12837 - protein, 363 aa, Nostoc punctiforme
MESLSKASYRIVAIPGEGIGPEVVEASLKILQHVAKIQGFTLQVDYGWLGATAFEQLGSYFPQATTELCDGADGIVFGAVSQGGLLELRKHFDFFCNLRPIRSVNSLLHKSSLRPEKIQGLDILIVRELVSGIYFGPSGRSSDERGNYGYHTMRYYDEEIRRIARKALEQAQYRRGLLTVAHKENALPHLHWTRLVQEEATKFPNVIVEPMLVDNLAMQMVLNPQRFDVILASNLFGDILSDIGGALVGSIGLLGSASLNANGFGLYEAIHGTAPDIAGLGIANPLGTLGACVLMLQQWGEVQAAQQIIAAQDRILAKGYRTADLFTQGEEILVNTATLVDLLLEELSVVQHSQLGVLHESRK

SEQ ID NO: 12838 - protein, 121 aa, Escherichia coli
MQFYVTQNHGTEPPFTGRLLHNKRDGVYHCLICDAPLFHSQTKYDSGCGWPSFYEPVSEESIRYIKDLSHGMQRIEIRCGNCDAHLGHVFPDGPQPTGERYCVNSASLRFTDGENGEEING

SEQ ID NO: 12839 - protein, 488 aa, Pylaiella littoralis
MPEDVQNRTRIKSERYESGVIPYAKMGYWDADYNVKDTDILALFRITPQPGVDPVEARAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLAGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAATCGPLKAALDLWKDITFDYTSTDTPDFVEVATESR

SEQ ID NO: 12840 - protein, 159 aa, Hordeum vulgare subsp. vulgare
QLMGFFMMTVFMLGLAVPYHHWTTPGNQIGFVVMYGFTFFFANFGPNATTFVVPAEIFPARLRSTCHGISAAAGKAGAMIGAFGFLYAAQDRHKPDAGYRPGIGVLNSLFVLAGVNLLGFMFTFLVPEANGKSLEEMSGEAQDNEEDQARTAAVQPSMA

SEQ ID NO: 12841 - protein, 469 aa, Oryza sativa
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 12842 - protein, 288 aa, Zea mays
MTGTTWIIDSQRFATKIKNASGSSDPSKQKWIGNPSKECPKCSHVIDNSDVVHQWPGLPKGVKFDPSDQELIWHLMAKHGKSGIKPHPFIDEFIPTVEEDEGICYTHPQKLPGVKQNGSVSHFFHRTFKAYNTGTRKRRRINTDDADVRWHKTGNTKPVLVDGKHLGCKKIMVLYISPLKGGKAEKTNWVIHQYHLGTGEDERDGEYVVSKLFFQQQFKPGDKNAQELTTSDDLESMAAESNLPDFTTLPTDKHVGTVQEVVHNPEHNLYQLIHHWPGLPKGVKFDPS

SEQ ID NO: 12843 - protein, 224 aa, Azotobacter vinelandii
MQPFAIAPSILSADFARLGEEVDRVLAAGADIVHFDVMDNHYVPNLTIGPMVCTALRKYGIQAPIDVHLMVKPVDRIIGDFLEAGASYITFHPEASEHIDRSLQLIRDGGARAGLVFNPATPLDCLKYVMDKLDMLLLMSVNPGFGGQKFIPGTLDKLREARALIDASGRDIRLEIDGGVNVKNIGEIAAAGADTFVAGSAIFGQPDYKAVIDAMRAELARVRP

SEQ ID NO: 12844 - protein, 210 aa, Gerbera hybrid cv. 'Terra Regina'
MGRGKVQLKRIENKINRQVTFSKRRGGLLKKAHEISVLCDAEVALIVFSAKGKLFEYSTDSCMENILDRYEQYSNIDRQHVAVDTDSPIRWTQECNKLKSRAELLQRNLRHYMGEDIESLGLREIQNLEQQLDTALKRIHSKKNQLLHQSISELQKKEKAIQEQNNTLIKNIKEKEKTITQKAQWEPHNYGPNTTPLLFSLPPHSSLNIG

SEQ ID NO: 12845 - protein, 422 aa, Triticum aestivum
  unsure (1)..(422): unsure at all Xaa locations
IVDSRGNPTVEVDLVAGDGSLHRSAVPSGASTGIYEALELRDGDKSVYGGKGVLTAVRNINEVIAPKLVGVDVRNQKDVDAIMLDIDGTENKSPVGANAILGVSLSVCRAGASAKGVPLYKHIQELSGTKELVMPVPAFNVINGGSHAGNNLAMQEFMLLPVGATSFAEALRMGSEVYHVLKGIIKAKYGQDACNVGDEGGFAPNVQDNREGLVLLMDAIEKAGYTGKIKIGMDVAASEFLMKDGSYDXANFKNQPNNGAHVLSAQSLCDLYKEFVKDFPIVSIEDPFDQDDWSSWASLQSSVDIQIVGDDLLVTNPKRIVEAIDKKACNALLLKVNQIGTVTESIQAALDSKAAGWGVMVSHRSGETEDNFIADLAVGLASGQIKTGAPCRSERLAKYNQLVRIEEELGNVRYAGEAFRSP

SEQ ID NO: 12846 - protein, 313 aa, Neisseria lactamica
MTKHIAILRGDGIGPEIVAETVRVLDKLIEQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSLGMLPSASLDENGKGLYEPSHGSAPDIAGQNKANPLATILSLAMLLRYSLNDEA

SEQ ID NO: 12847 - protein, 489 aa, Agrobacterium tumefaciens str. C58
MRERSMIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 12848 - protein, 178 aa, Zea mays
  unsure (1)..(178): unsure at all Xaa locations
MDPTKFRPSSSHDTTVTTTNAGAPVWNDNEALTVGPRGPXLLEDYHLIEKVAHFARERIPERVVHARGASAKGFFECTHRXVTSLTCADFLRAPXGCGRPVIVRFSTVIHERGXSPETIRDPRGFAREAPTPREGNWGPCWANNFPVFFIRDGLRVPPTWIHAFSPSRVEREKKNGPA

SEQ ID NO: 12849 - protein, 347 aa, Agrobacterium tumefaciens str. C58 (U. Washington)
MKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 12850 - protein, 510 aa, Glycine max
MFIENFKVESPNVKYTETEIQSVYNYETTELVHENRNGTYQWIVKPKSVNYQFKTNTHVPKLGVMLVGWGGNNGSTLTGGVIANREGISWATKDKIQQANYFGSLTQASAIRVGSFQGEEIYAPFKSLLPMVNPDDIVFGGWDISNMNLADAMARAKVFDIDLQKQLRPYMESMVPLPGIYDPDFIAANQEERANNVIKGTKQEQVQQIIKDIKAFKEATKVDKVVVLWTANTERYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIQFKAENEGKFHSFHPVATILSYLTKAPLVPPGTPVVNALSKQRAMLENIMRACVGLAPENNMILEYK

SEQ ID NO: 12851 - protein, 492 aa, Raphanus sativus
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 12852 - protein, 339 aa, Haemophilus influenzae Rd
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 12853 - protein, 398 aa, Oryza sativa (japonica cultivar-group); identical to SEQ ID NO: 8331

SEQ ID NO: 12854 - protein, 824 aa, Chlamydophila pneumoniae CWL029
MEDFSSFDKNKVSVDSMKRAILDRLYLSVVQSPESASPRDIFTAVAKTVMEWLAKGWLKTQNGYYKNDVKRVYYLSMEFLLGRSLKSNLLNLGILDLVRKALKTLNYDFDHLVEMESDAGLGNGGLGRLAACYLDSMATLAVPAYGYGIRYDYGIFDQRIVNGYQEEAPDEWLRYGNPWEICRGEYLYPVRFYGRVIHYTDSRGKQVADLVDTQEVLAMAYDIPIPGYGNDTVNSLRLWQAQSPRGFEFSYFNHGNYIQAIEDIALIENISRVLYPNDSITEGQELRLKQEYFLVSATIQDIIRRYTKTHICLDNLADKVVVQLNDTHPALGIAEMMHILVDREELPWDKAWEMTTVIFNYTNHTILPEALERWPLDLFSKLLPRHLEIIYEINSRWLEKVGSRYPKNDDKRRSLSIVEEGYQKRINMANLAVVGSAKVNGVSSFHSQLIKDTLFKEFYEFFPEKFINVTNGVTPRRWIALCNPRLSKLLNETIGDRYIIDLSHLSLIRSFAEDSGFRDHWKGVKLKNKQDLTSRIYNEVGEIVDPNSLFDCHIKRIHEYKRQLMNILRVIYVYNDLKENPNQDVVPTTVIFSGKAAPGYVMAKLIIKLINSVADVVNQDSRVNDKLKVLFLPNYRVSMAEHIIPGTDLSEQISTAGMEASGTGNMKFALNGALTIGTMDGANIEMAEHIGKENMFIFGLLEEQIVQLRREYCPQTICDKNPKIRQVLDLLEQGFFNSNDKDLFKPIVHRLLHEGDPFFVLADLESYIAAHENVNKLFKEPDSWTKISIYNTAGMGFFSSDRAIQDYARDIWHVPTKSCSGEGN

SEQ ID NO: 12855 - protein, 94 aa, Zea mays
MAKASSRLLFSLSLVVLLLLVETTTSPHGQADAIDCGASCSYRCSKSGRPKMCLRACGTCCQRCGCVPPGTSGNEDVCPCYANMKTHDGQHKCP

SEQ ID NO: 12856 - protein, 515 aa, Edwardsiella tarda
MHIVNGINGLIAKKNVLFFLTSLAISPSVLADTLTRDNGAPVGDNQNSQTAGPIGPVMLQDVQLLQKLQRFDRERVPERVVHARGTGAHGVFTPTADISDLTVAKVFTPGSTTPVFVRFSSVVHGTHSPETLRDPRGFATKFYTAEGNWDLVGNNFPTFFIRDAIKFPDMVHAFKPDPRTNLDNDARRFDFFSHLPESTRTLTLLYSNEGTPLSYRNMDGNSVHAYKLINDKGEVHYVKFHWKTRQGIKNLDPQQVEQIQGKDYSHMTQDLVTAINRGDYPKWDLYIQVLKPADLKNFDFDPLDATKVWPDVPERKIGEMVLNKNPDNVFQETEQVAMAPSNLIPGIEPSEDKLLQGRLFAYADTQFYRIGANGLSLPINKPHSAVNNGNQDGQLNSGHTLDKGVNYQPSRIYPREELVSSRYSQTPLSGTTQQSKIQREQNFKQAGELYRSYSKKEQNDLINSLGTSLASADTVSKNIMLSYFYKADKDYGTRLTSVANGDLPTVKNLADKLQD

SEQ ID NO: 12857 - protein, 117 aa, Zea mays
  unsure (1)..(117): unsure at all Xaa locations
KQPYNVSVAAEVSXACAALQNPTYLENVKNFLVKERERLFNLLKGIPFLKPFPSHSNFILCEVTSGKDAKKIKEDLAKMGVMIRHYDKKELKGYIRISVGKPEHTEALMKGLNALRL

SEQ ID NO: 12858 - protein, 868 aa, Saccharomyces cerevisiae
MNATKELTFNLLNKFQDKERFGSAQRHAGISLKGFISGILFSFLYFLFQLSLFIILRSRFKTIYQANVVLKIHPGSKVCFAKKKIKNYWSLFAFLKQLPGRMLDPMEKFERNERYGLDNYLFLRFLKLLIFFFAVLSIINIPILIPIHYFSRDILKENEGERYEQSFRTTSKLDKWTMSNLSPNSSNTLICHLFLSIFVVLWFHFILSSELRFVNRLGYSVLTKSKYQNILYLEGFSSKLVTQSISLETFFQPLHSDCFGVTHFIPKNLKKVHKLEIKLNKLQKSKEQIIFEIILEKYFRRVSIHRHLIANHKRFFFSKLKNHLLFQYKKLVFLTQFRISYYCTKIRLRWKKSSIFPLYYPKLYVNTETILERKYRILDKIIRKEKLIKFQVNSLKATSETKQALPDDLSSGTDIYMDKMFITFKSTLLSNVIGELLSYRLPTQNLKVIIGPNVNDIIWRNILDSSPLWKSAKYFSANILRIFVIIGWILPVAFLGLISQIPNISSLIPFTKIIHFQSPFIREVAKNLIPIVTLIIIIEIVPYFFRWLSYLRGLKTGAQIEADVQNWYFVFVFIHLFVVVTISSGFSIIIERLLNNPVSIPALLANDLPKCANFFCSFVLIRGMAYAGGNLLRIKELLFELFYYKWKRSTPHAQFKRLKTSLFFQLGSIYPIFSVLGCIGIIYSVVAPIILLLCCISFSMVFFSFSYLFKYQYNKENYSETFGKLYIQALMQLYAGIYFMEFCLLGLFTLFDQYTLSTIMLVVFALTVITHSKISKQIKSKPQRIPTLEYLSNLTEERKDQFCQESYTFHDIFSICRNSDEIWLPRDKLGISEEEQSFLEKSYHLKFDLNMYSMNLFGDCHLENSHLH

SEQ ID NO: 12859 - protein, 284 aa, Physcomitrella patens
MGRGKIEIKKIENTTSRQVTFSKRRGGLLKKAHELAVLCDAEVALVIFSSTGKLFEYASSGSIRDIIDRYKKGSDGMQNGARNDFMGCEVVKLREQLEQLKASHRHMLGEDLSLLKVPDLLQLEQQLDLGASRVRARKNQLILEEVESLRRKEHELLIANEDLRQKLADAQGIADAVTARANVSESPRPLTSALTRDIVMSSQQQEVTVHPHPNLRDAQRSQTSLQLGMFSSESYLPSSSRGPSEHPIPVGPEGCAGESAMRWEHPHFHSQNRLHANISPSVRI

SEQ ID NO: 12860 - protein, 363 aa, Buchnera aphidicola (Uroleucon helianthicola)
MKQKYRIAILPGDGIGPEVMREAYKILSILKDHFSLSLEIQEFNIGGSAIDQEGIALPKKTLLGCQNSDAILFGSVGGKRWDHLPINERPERASLLPLRKHFNLFANLRPAKLYSELQHLSPIRSNIIKNGFDILCVRELTGGIYFGKPSDRVKKNNVEYAFDTEVYYDYEINRIAHLAFQLARTRKFKVCSIDKSNVLNSSILWREVVEKVSKMYPDVHLSHLYIDNATMQIIKNPNQFDVLLCSNLFGDIISDECAVITGSIGMLPSASFNEKNFGLYEPAGGSAPDIAGKNTANPIAQILSLSMLVRYGMKLNKIADKIDDAVALSLKAGYRTADISNDNNFLKTNEMGDVIANFLINGK

SEQ ID NO: 12861 - protein, 186 aa, Halobacterium sp. NRC-1
MSTLTDTIQIENVVASTDLSQELALEQLATDLPGAEYNPGDFPGVIYRLDDPKSATLIFDSGKAVCTGAQSVDDVHDAISIVVEDLRDLGIDIPPSPPVHVQNIVCSGSLDQDLNLNAIAIGLGLEDVEYEPEQFPGLVYRLNDPDVVVLLFGSGKLVITGGSNPDDAHHALEIIHERLTDLGLLE

SEQ ID NO: 12862 - protein, 316 aa, Salmonella enterica subsp. enterica serovar Typhi Ty2
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDVRLSFDKEKSIEKARHLVDLYQQQDVDKSRILIKLAATWEGIRAAEQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTPMTEAEFRWEHNQDAMAVEKLSEGIRLFAVDQRKLEDLLAAKL

SEQ ID NO: 12863 - protein, 136 aa, Triticum aestivum
  unsure (1)..(136): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSXKWVPLPRSSARLGFIFREAQRNSPXGYYELGRVLGQCGKLPMFGMQPTPNAR

SEQ ID NO: 12864 - protein, 152 aa, Hordeum vulgare
HMGVKIAKAMGHHVTVISSSDKKRQEALEHLGADDYLVSSDSTRMQEVADSLDYIIDTVPVFHPLEPYLSLLRLDGKLILMGVINTPLQFLTPVVMLGRKTITGSFVGSIKETEEMLEFCKEKGLSSMIEVVKMDYVNKALERLEKNDVRYR

SEQ ID NO: 12865 - protein, 316 aa, Photobacterium profundum
MSTKLEQLRALTTVVADTGDIEAISKYQPEDATTNPSLILKAAQIAEYAPLIDASIAYAKAQSNDKTQQVADTCDMLAVNIGKEILKVVPGRISTEVDARLSYDTEGSVIKARQLIKMYNDAGITNDRILIKLASTWEGIRAAEVLEKEGINCNLTLLFSFAQARACAEAGVFLISPFVGRIMDWYKAKEGRDFESSEDPGVVSVTGIYDYYKTYGYNTVVMGASFRNIGEILELAGCDRLTISPNLLQELEDATGEVVEKLIDTNGTKERPAAMTHAEFLWEHNQDPMAVEKLADGIRNFAVDQGKLEVMIAERL

SEQ ID NO: 12866 - protein, 347 aa, Salmonella typhimurium LT2
MKIRVFMATVLLLISHCVFSTTSLPHIVILATGGTIAGTAANNTQTAGYKSGELGVQTLINAVPEMNNIARVDGEQVANIGSENMTSDIILKLSQKVNALLARDDVDGVVITHGTDTLDETAYFLNLTVKSDKPVVFTAAMRPASAISADGAMNLLEAVTVAADPNAKGRGVMVVLNDRIGSARFVTKTNATTLDTFKAPEEGYLGVIVNGQPQFETRVEKIHTLRSVFDVRNIKKLPNVVIIYGYQDDPEYMYDAAIAHHADGIIYAGTGAGSVSVRSDAGIKKAEKAGIIVVRASRTGNGVVPLDKGQPGLVSDSLNPAKARVLLMTALTQTRNPELIQSYFSTY

SEQ ID NO: 12867 - protein, 432 aa, Escherichia coli O157:H7
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 12868 - protein, 440 aa, Ahnfeltiopsis humilis
  unsure (1)..(440): unsure at all Xaa locations
QPGVDPVEASAAVAGESSTATWTVVWTAVLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYDTLLLPYLKVNLPQGIFFEQDWASLRKVTPVASGGIHCGQMHQLLDYLGVDVVLQFGGGTIGHPDGIQAGATANRVALESMVIARNEGRXYVTEGPQILQDAAKTCGPLQTALDLWKDITFNYTSTDTADFVETPTANV

SEQ ID NO: 12869 - protein, 202 aa, Glycine max
MGLSILRSTSISTPISSSKSKPIFSTLVRSSFASISPTKCVTPTTLFVSATPFFTASPKRGFRGGIVAMAAAGSLRKSEEEWRAVLSPEQFRILRQKGPEFPGTGEYDKFFDEGVYNCAGCGTPLYRSLTKFNSGCGWPAFYEGIPGAINRNPDPDGMRTEITCAACGGHLGPVFKGEGFPTPPNERHCVNSISLKFAPAHF

SEQ ID NO: 12870 - protein, 507 aa, Juniperus ashei
MSMKFMAALAFLALQLIVMAAGEDQSAQIMLDSDTKQYHRSSRNLRKRVHHARHDVAIVFNVEHYGAVGDGKHDSTDAFEKTWNAACNKLSAVFLVPANKKFVVNNLVFYGPCQPHFSFKVDGTIAAYPDPAKWKNSKIWMHFARLTDFNLMGTGVIDGQGNRWWSDQCKTINGRTVCNDKGRPTAIKIDFSKSVTVKELTLTNSPEFHLVFGECDGVKIQGIKIKAPRDSPNTDGIDIFASKRFEIEKCTIGTGDDCVAVGTGSSNITIKDLTCGPGHGMSIGSLGKGNSRSEVSFVHLDGAKFIDTQNGLRIKTWQGGSGLASHITYENVEMINAENPILINQFYCTSAAACKNQRSAVKIQDVTFKNIHGTSATTAAIQLMCSDSVPCSNIKLSNVFLKLTSGKVATCVNKNANGYYTNPLNPSCKSLHPGRTPKELELHQKPTTLLMDEKMGASLNSSPPNCKNKCKGCQPCKPKLIIVHPNQPEDYYPQRWVCSCHNKIYNP

SEQ ID NO: 12871 - protein, 414 aa, Petroselinum crispum
NSARGNTDDVKAVKPEKLSSPPPPAAPDQSNSHVYPDWAAMQAYYGPRVALPPYFNPAVASGQSPHPYMWGPPQPVMPPYGVPYAALYAHGGVYAHPGVPLAASPMSMDTHAKSSGTNEHGLIKKLKGHDDLAMSIGNGKADSSEGEMERTLSQSKETEGSSDGSNENSKRAAVNGRKRGRDEAPNMIGEVKIETQSSVIPSPRAKSEKLLGITVATPMVAGKVVGTVVSPSMTSSLELKDSPKEHAVNSPAGGQQPSTMMPNDSWLHNDRDLKRERRKQSNRESARRSRLRKQAEAEELAIKVDSLTAENMALKAEINRLTLTAEKLTNDNSRLLEVMKNAQAERAADVGLGNNNEKKASTLSTANLLSRVDNAGSGDRDEGESDVYEKTTKSGAKLHQLLDANPRTDAVAAG

SEQ ID NO: 12872 - protein, 486 aa, Gelidium pacificum
  unsure (1)..(486): unsure at all Xaa locations
NSVEERTRIKNQRYESGVIPYAKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAAXXXIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAIVIARNEXXXXXXXGPQIXRDAAKTCGPLQTALDLWKDISFNYTSTDTADFVETPTANV

SEQ ID NO: 12873 - protein, 357 aa, Oryza sativa; identical to SEQ ID NO: 9062

SEQ ID NO: 12874 - protein, 183 aa, Arabidopsis thaliana
YPYIAGMGVYCFKTEALLKLLTWRYPSSNDFGSEIIPAAIKDHNVQGYIYRDYWEDIGTIKSFYEASIALVEEHPKFEFYDQNTPFYTSPRFLPPTKTEKCRIVNSVISHGCFLGECSIQRSIIGERSRLDYGVELQDTLMLGADSYQTESESRLLAEGNVPIGIGRDTKIRKCIIDKNARIG

SEQ ID NO: 12875 - protein, 468 aa, Phyllariopsis purpurascens
IPYAKMGYWDADYNVKHTDILALFRITPQPGVDPVEAAAAVAGESSTATWTVVWTDLLTACDIYRAKAYRVDPVPGTNDQYFAYVAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATIEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVPTGSN

SEQ ID NO: 12876 - protein, 200 aa, Zea mays; identical to SEQ ID NO: 7531

SEQ ID NO: 12877 - protein, 273 aa, Cornicularia normoerica
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTELNGDNHSCIF

SEQ ID NO: 12878 - protein, 267 aa, Bifidobacterium longum DJO10A
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 12879 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSS

SEQ ID NO: 12880 - protein, 338 aa, Trichoderma harzianum
MSIKVGINGFGRIGRILLSNALEKPELSVVAVNDPFIEPTYAAYMLKYDSSHGLFKGDIEVDGQNLVVNGKPIRFYSERDPANIKWSETGAEYIVESTGVFTTIDKAKAHLNGGAKKVIISAPSADAPMFVMGVNHKDYDGTPTVLSNASCTTNGLAPLVKIVNDNFGIVEGLMTTVHSYTATQKTVDGPSGKDWRGGRGAAQNIIPSSTGAAKAVGKVIPAMNGKITGMSFRVPSANVSVIDLTVRLEKAASYEEITSAIKKAADGELKGIMAYTSDEVVSTDMLGNNNSSIFDIKAGISLNPNFVKLVSWYDNEWGYSRRVLDLLEHVAKVDASKK

SEQ ID NO: 12881 - protein, 85 aa, Mesembryanthemum crystallinum
MKVKKGYMAVQVGLEVEEEYYGGTSEESQRFVIPISYLYNPLFVGLLDKAREVYGYHADGPLKLPCSVDDFLDLRWRIERENSSH

SEQ ID NO: 12882 - protein, 432 aa, Enterococcus faecalis V583 [sequence omitted]

SEQ ID NO: 12883 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHVFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 12884 - protein, 90 aa, Glycine max
  unsure (1)..(90): unsure at all Xaa locations
VRVNAAFHNARPENTXVPGVNDLPITRNXLIGGDDYTSGHTATKSGYVETLETAMIKSTSIGSPNRSGCSDGMNVSAAKPCALRHSPRAV

SEQ ID NO: 12885 - protein, 446 aa, Zea mays
  unsure (1)..(446): unsure at all Xaa locations
MAATIQSVKARQIFGSRGNPTVEVDVFCSDGTFARAAVPSGASTGVYEALELRDGGSDYLGKGVSKAVNNVNSVIGPALIGKDPTAQTEIDNFMVQQLDGTXNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 12886 - protein, 225 aa, Brassica rapa
MMSSFPLVSFLITLMLASRVCTHGENRVDDTDGNPLRTTAQYLILPLSPRSNGGGLLPVPVKLQPLCPLGISQSSVKALTGLPVSFSYPYAIMDTYVNEMEAINIEFKSDAWPGCEEFSKYWEVDESSSASEEPAVLVGGKSTERNSWFRIERKEPFYGGVAYKLTTLTGTIGTVPGPLGQAPQLVLTNDDCETSLIHRFMIVHGDTPATTSRQEKLGLRMFPFY

SEQ ID NO: 12887 - protein, 634 aa, Aspergillus awamori
MRVSTSSLALSVSLFGKLALGLSAAEWRSQSIYFLLTDRFGRTDNSTTATCDTGDQIYCGGSWQGIINHLDYIQGMGFTAIWISPITEQLPQDTSDGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQDYLDGVLNYPIYWQLLYAFESSSGSISDLYNMIKSVASDCSDPTLLGNFIENHDNPRFASYTSDYSQAKNVLSYIFLSDGIPIVYAGEEQHYSGGDVPYNREATWLSGYDTSAELYTWIATTNAIRKLAISADSDYITYANDPIYTDSNTIAMRKGTSGSQVITVLSNKGSSGSSYTLTLSGSGYTSGTELIEAYTCTSVTVDSNGDIPVPMASGLPRVLLPAWVVDSSSSLWGGSTTTTTSSSTSTSTSKATSSSSTTTSSSCTATSTTLPITLEELVTTTYGEEIYLSGSISQLGEWDTSDAVKLSADDYTSSNPEWYVTVSLPVGTTFEYKFIKVEEDGSVTWESDPNREYTVPECGSGETVVDTWR

SEQ ID NO: 12888 - protein, 219 aa, Shewanella oneidensis MR-1
MTQQTLYSTSATTLEVNKLLKNTYLLLAMTLAFSALCAGLAMALNISPLMSLGLSIGGLVLLFVTLRKADSAAGIFWVFAFTGMEGASLGYMLNHYAGMTNGSELIMQAFGLTSVIFIALSAYAVTTKKDFSFMRGFLFAGLIVVIAAAIINIFVGNSVAFMAINAGLALLMTGFILFDTSRIVNGGETNYIRATISLYLDFLNLFIAILHLLGIGNDD

SEQ ID NO: 12889 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 12890 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 12891 - protein, 1241 aa, Arabidopsis thaliana
MLVARSGCSRTLIRMGNDENLMVMVDVEEGEIPDSVNTEIEVKHKSTTTTADVGGDVDVGVVAGGRGGGGGGSNGNSRVWTMEELISQYPAYRPYANSGLSNLAWARAVQNKPFNEGLVMDYEPRESDKIVIEDSDDEKEEGELEEGEIDLVDNASDDNLVEKDTESVVLISADKVEDDRILKERDLEKKVKLIRGVLESTSLVEAQTGFEGVCSRILGALESLRELVSDNDDFPKRDTLVQLSFASLQTINYVFCSMNNISKERNKETMSRLLTLVNDHFSQFLSFNQKNEIETMNQDLSRSAIAVFAGTSSEENVNQMTQPSNGDSFLAKKLTSESTHRGAAYLRSRLPMLPLLDLHKDHDADSLPSPTRETTPSLPVNGRHTMVRPGFPVGRESQTTEGAKVYSYESDARKAVSTYQQKFGLNSVFKTDDLPSPTPSGEPNDGNGDVGGEVSSSVVKSSNPGSHLIYGQDVPLPSNFNSRSMPVANSVSSTVPPHHLSIHAISAPTASDQTVKPSAKSRDPRLRLAKPDAANVTIYSYSSGDARNLSKVELSADLVNPRKQKAADEFLIDGPAWKRQKSDTDAPKAAGTGGWLEDTESSGLLKLESKPRLIENGVTSMTSSVMPTSAVSVSQKVRTASTDTASLQSLLKDIAVNPTMLLNLLKMGERQKVPEKAIQKPMDPRRAAQLPGSSVQPGVSTPLSIPASNALAANSLNSGVLQDSSQNAPAAESGSIRMKPRDPRRILHGSTLQRTDSSMEKQTKVNDPSTLGTLTMKGKAEDLETPPQLDPRQNISQNGTSKMKISGELLSGKTPDFSTQFTKNLKSIADMVVVSQQLGNPPASMHSVQLKTERDVKHNPSNPNAQDEDVSVSAASVTAAAGPTRSMNSWGDVEHLFEGYDDIQRVAIQRERVRRLEEQNKMFASQKLSLVLDIDHTLLNSAKFNEVESRHEEILRKKEEQDREKPYRHLFRFLHMGMWTKLRPGIWNFLEKASKLYELHLYTMGNKLYATEMAKLLDPKGVLFNGRVISKGDDGDPLDGDERVPKSKDLEGVMGMESSVVIIDDSVRVWPQHKMNLIAVERYLYFPCSRRQFGLLGPSLLELDRDEVPEEGTLASSLAVIEKIHQNFFSHTSLDEVDVRNILASEQRKILAGCRIVFSRIIPVGEAKPHLHPLWQTAEQFGAVCTTQVDEHVTHVVTNSLGTDKVNWALTRGRFVVHPGWVEASAFLYQRANENLYAINP

SEQ ID NO: 12892 - protein, 470 aa, Glossomastix chrysoplasta
GVIPYAKMGYWDADYAVKDTDVLAMFRITPQPGVDPIEAAAAVAGESSTATWTVVWTDLLTACDIYRAKAFRVEPVPGASDQFFSYIAYECDLFEEGSLPNLTASIIGNVFGFKAVSALRLEDMRIPYAYLKTFQGPATGIVVERERMDKYGRPFLGATVKPKLGLSGKNYGRVVYEGLRGGLDFLKDDENINSQPFMRWRERFLYVMEGVNRAAAASGEVKGSYLNATAATMEEMYERCDYAKSVGTIIVMIDLVIGYTAIQSMSVWARKNDMILHLHRAGNSTYARQKNHGINFRVICKWMRMAGVDHIHAGTVVGKLEGDPLMVKGFYNTLLDVELSINLPQGLFFDMDWASLRRCVPVASGGIHCGQMHQLIHYLGEDCVLQFGGGTIGHPDGIQAGATANRAALEAMILARNEGRDYLGQGPEILSAIARKCRPLQVALDLWKDISFNYTSTDTADFVETPTQNI

SEQ ID NO: 12893 - protein, 496 aa, Synechocystis sp. WH 8501
MVSTRTKKDVPIWQPLKVIARSFSPYWIACIPLAAIITIVWNKAVVAESVELITAEGNSEAIAQLQGTLNAIWVLIAAILVIFMNAGFGMLETGFCRQKNAVNILSKNLIVFALATLAYWAIGYSLMFGGPENPFIGFGGWFLSGEPATYGLDPFPAGLPISVAFLFQAAFAGTAATIVSGAVAERIKFTDFIIFSLLLVGISYPITGHWVWTGNGWLGSIGFSDFAGSTVVHSVGGWAALMGAAILGPRMGKYVEGRPQAIPGHNMSIATLGCLILWIGWFGFNPGSQLAADEAVPYIAVTTNLAAAAGGVAATFVAWFKDGKPDLSMIINGILAGLVGITAGCDGVSYFGAVIIGAVAGVIVVYSVSMIDSLLKIDDPVGAVSVHLVNGIWGTLAVGLFNTESGLFYGGGFAQLGSQIVGIVAIGAFTAIFSGIVWTVLKSTMGIRVSPEEELEGLDVGEHGMEAYAGFLKETDTFSGSGSSTADEDVTTGAGI

SEQ ID NO: 12894 - protein, 386 aa, Oryza sativa
FVNKALNMVCCWVEDPNSDSFKRHLARIPDFLWLSEDGMKAQSWETAFIIQAFCATDLVNEYGSTVRRAHEFMKNSQIMRNHPGDQSYWHRHRSKGSWTLSSADNGWAVSDTTAEALKAVLLLEKISSNVVGDPIEIERLHDAVDCLLSFVNKDGTLSTYECKRTYTWIEVLSPCESFPNIVVDYPFPECTSSVLQALVLFKQLHPSYRIKEIEKCVRNAAMFIESTQGEDGSWLGTWGVCFTYGAFLSVKGLIAAGRTYENSSSIRKACDFILSKQLDTGGWGESYVSNITKVYVNIKDDQAHAVNTAWAMLALICAGQMERDPAPLHRAAKELINMQLETGEFPQQEHVGAFNACLFFNYPNYRNLFPIWALGEYCRHLHSTRR

SEQ ID NO: 12895 - protein, 121 aa, Triticum aestivum/Thinopyrum intermedium alien addition line
RHGRHLLGTTVCWFVLDIAFYSQNLFQKDIYTAVEWLPRADTMNALQEMFKISRAQTLVALCGTIPGYWFTVFLIDVVGRFAIQLGGFFFMTAFMLGLAVPYHHWTTPGNHVGFVVMFSLT

SEQ ID NO: 12896 - protein, 243 aa, Arabidopsis thaliana
MRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 12897 - protein, 378 aa, Glycine max
  unsure (1)..(378): unsure at all Xaa locations
VKTQVQVQVLQGQISCTLQLVVETIIHHHQHHSHHTPTPTQFPINTFHLQSGGSDHCFQSDQVSPHPSVKSEASTSQLHAPIFHYPLMRGNLHNTMHHHHPQQQQGGSPTSSTGEVEAIKAKIIAHPQYSNLLEAYMFNLXIGAPPEVVARMAAAKQEFEARQRSSVGSRETSKDPELDQFMEAYYDMLVKYREELTRPIQEAMDFMRRIETQLNMLCNGPVRIFSDDKCEGAGSSEEDQDNSGGETELPEIDPRAEDRELKNHLLKKYSGYLSSLKQELSKKKKKGKLPKDARQKLLNWWELHYKWPYPSESEKVALAESTGLDQKQINNWFINQRKRHWKPSEDMQFMVMDGLHPQSATLYMDGHYMADGHYRLGP

SEQ ID NO: 12898 - protein, 536 aa, Oryza sativa (japonica cultivar-group)
MRKNPSEQEEEEKETEKKANEIEVQFPFRPTDPTHLPQPQVDAQVHHPCSIRTNTTTQTTYRCDTRSRAKRYHPPIHGGLHLRHLLLHSHQARLLLLLLLKSQLRLLRQVSIGVALGGWIFAGSLAAIGDVMTASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 12899 - protein, 305 aa, Eremothecium gossypii
MSDNKQSNFLINFMMGGVSAAVSKTAAAPIERVKLLIQNQDEMLKQGSLDRRYNGIVDCFKRTAASEGVISFWRGNTANVIRYFPTQALNFAFKDKIKAMFGFRKEVDGYAKWFAGNLASGGAAGGLSLLFVYSLDYARTRLAADSKSAKKGGERQFNGLVDVYKKTLASDGIAGLYRGFLPSVVGIVVYRGLYFGMYDSLKPLLLTGNLESSFIASFLLGWAVTTGASTASYPLDTVRRRMMMTSGQAVKYDGAFDAFRKIVAAEGVKSLFKGCGANILRGVAGAGVISLYDQLQLVLFGKKFK

SEQ ID NO: 12900 - protein, 332 aa, Helicobacter pylori J99
MKIFINGFGRIGRCVLRAILERNDTNPQLEVIGINDPANWEILAYLLEHDSTHGLLNKEVRYSNGKLIIGSLEIPVFNSIKDLKGVGVIIECSGKFLEPKTLENYLLLGAKKVLLSAPFMGEYDEKQYPTLVYGVNHFLYQNQAIVSNASCTTNAIAPICAILDKAFSIKEGMLTTIHSYTSDQKLIDLAHPLDKRRSRAAASNIIPTTTKAALALHKVLPNLKNKMHGHSVRVPSLDVSMIDLSLFLEKKALKDPINDLLITASKGTLKGVLEIDLKERVSSDFISNPNSVIIAPDLTFTLENMVKIMGWYDNEWGYSNRLVDMAQFMYHY

SEQ ID NO: 12901 - protein, 348 aa, Saccharomyces bayanus
MSIPKTQKGVIFYESHGKLEYKDIPVPTPKANELLINVKYSGVCHTDLHAWHGDWPLPVKLPLVGGHEGAGVVVAMGENVKGWNIGDYAGIKWLNGSCMACEYCELGNESNCPHADLSGYTHDGSFQQYATADSVQAAHIPKGTDLAECAPVLCAGITVYKALKSANLSAGQWVAISGAAGGLGSLAVQYAKAMGYRVVGIDGGEGKEELFRSIGGEVFIDFTTEKDIVGAVIKATDGGAHGIINVSVSEAAIEASTRYCRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 12902 - protein, 441 aa, Chlorobium tepidum TLS
MKSFLSKSGAIAAGLLLAAATFSPPIQAATPTPDAVNAFAIDNFFLFICAVLVLFMQAGFALVETGLNSAKNAVNILFKNLMDMAIGGIIYYFVGYGLMYPGEAFSGGFFGFGGPGISTAMPEIAGGTLYPAVDFLFQVAFAATAATIVSGAVAGRMQFRAYLIYSAVISAVVYPISGFWLWGGGWLKALGFHDFAGSLLVHALGGFAGLAGAIVLGPRIGRFNEDGTPNAMPGHNLALSTLGVFILLIGWYGFNPGSQLAIVGGDNTAAVMKIAVNTTLAACAGAVVAMIFAWGLFKKPDLTMALNGMLAGLVAITANCDVVSYNASLIIGAVGGILVVLGIMLLDKLRIDDPVGAWPVHGLNGIWGGVAAWIFGGQPMVAQLVGSLVVPFWGFVTMMVLFLILKAMGILRVHKDEEMKGLDISEHEEEAYYGFDIYTTQ

SEQ ID NO: 12903 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 12904 - protein, 192 aa, Mitthyridium sp. Wall 3859
  unsure (1)..(192): unsure at all Xaa locations
GGAKKVVISAPSKDAPMFVMGVNEEKYTNEDIVSNASCTTNCLAPLXKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIALSDT

SEQ ID NO: 12905 - protein, 364 aa, Ralstonia eutropha
MPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 12906 - protein, 104 aa, Zea mays
  unsure (1)..(104): unsure at all Xaa locations
AXDGCEKTTEGHTXKELEDMKKRLKEIEEEASALREMQAKVEKEMGAVQDSSGTSATQAEKEEVDARSIYVGNVDYACTPEEVQQHFQSCGTVNRVTXTDRQIG

SEQ ID NO: 12907 - protein, 228 aa, Sorghum bicolor
KVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQGAVGPADTDPGPDKLIIVLLHDEAGSAGSAASTKHMLPAADNRRER

SEQ ID NO: 12908 - protein, 247 aa, Dendrobium grex Madame Thong-IN
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 12909 - protein, 187 aa, Sequoia sempervirens
ICTYFAQPLHQRDYTRWPEKPEGWREIVDKYSETLMGLATKLLAIVSEALGLEPEAVTKACVEMDQKVVINYYPKCPQPDMTLGLKRHTDPGTITLLLQDQVGGLQATKDNGVNWITVEPVQGAFVVNLGDHMHYLSNGKFKSADHQAVVNSNSSRLSIATFQNPSQEAIVYPLKLEEGEQSFMEEP

SEQ ID NO: 12910 - protein, 257 aa, Triticum aestivum
  unsure (1)..(257): unsure at all Xaa locations
MDPYKYRPSSSFNAPMWSTNSGAPVWNNDNSLTVGSRGPILLEDYHLVEKIADFDRERIPERVVHARGASAKGFFEVTHDVSHLTCADFLRAPGVQTPVIVRFFNVIHERGFPETLRDPRXXAIKFYTREGNWDLVGNNFPVXFIRDGMKFPDMVHALKPNPKTHIQENWRILDXXFHHPEXLPHVXTFFFDDIRXXPPDYXHNGTGFRGTTLPLCPAARQRHLRSKVPESPTLGGGQFFFGRQGGGPPQGPPDLGP

SEQ ID NO: 12911 - protein, 316 aa, Streptomyces avermitilis MA-4680
MAYDLITMGRIGVDLYPLQTGVPLPQVTSFGKFLGGSATNVAVAAARLGRSTAVVTRTGDDPFGTYIHEALRGFGVDDRWVTQVAGLPTPVTFCEIFPPDDFPLYFYRQPKAPDLEIDAHELDLDEIRAARIFWMTGTGLSEEPSRTATLAALAHRAKSGTTVFDLDWRPMFWADPAQARPFYTEALRHTTVAVGNVDEVEIATGERDPHSAARALLAAGVELAVVKQGPKGVLAVHRDGTTAEVPPLPVKVLNGLGAGDAFGGSLCHGLLDGWDLERLMRYANAAGAIVASRLECSSAMPTPAEVEDALTAGAVL

SEQ ID NO: 12912 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLG

SEQ ID NO: 12913 - protein, 730 aa, ASPERGILLUS NIDULANS FGSC A4
MSSRAIRKLQKLREQEQQAELQAQESSEDELIAKPSKPKPNAFDLLNAADNDDDEDEQPSEGEAPESVNQPTEEVTIPAAPDPVQKKKKKTKNKKKKNAAKQEPTNEGSADKDLDEIDRALKELAVQSQVEAGVQRTEERVDARFSRDPEDFLSIDSKQLNATNEMRKLFGNVVLENFDQPDSGSGRRRDRGRETIDLGRALTGRYSPASRGLSLAGVTQRRNILFQGKDEWPRAPSGGLGMEVAESLPNGVTVYRFVHNAAYQDVQRQFDLCVESMDPQRMIHLLQYNPYHISTLLQVSEIAKHQGDHAVSADLLERALFNFGRSVHSSFGNRLRDGRARLDFLHAENRELWLVGWRYIANLGMKGTWRTAYEWAKLLLSLDLKDPYCIKLMIDNLALRGREWSHFIDLCTQTRLSQEWKYLPNIQCSLALAYLRLNKQKECRQQMRVAMSRYPWVFCKLAQELDIQPIPKRIWGKLPPTDGHELFTELYIVRTKDLWNTPEVISLLVEVADTLSEGDEPIEPPEITLDIARHVVLSDVPRVTTHLPTRFVSGRISASDPLPPYESEAFRQQSDPTPSYLSRVPEAERPGWIRNLMEQLNHGVIPFPRFRAGDEEDHGDNEPVENHVLPVSGPEEQVVLEQWLLGDGLQTLEAFIRQHGVDRGNWDEEIDYSPLHEYVDTLFEIVPDSARQALLDGAIREAAGPIVVSLLQDEMELTRLELEEQQRDGQ

SEQ ID NO: 12914 - protein, 109 aa, Triticum aestivum
MDHAADAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVD

SEQ ID NO: 12915 - protein, 360 aa, Catalpa speciosa
MVGSLTPSKKREYRVTNRLQEGKRPIYAVVFNFIDSRYFNAFATAGGNRVTVYQCLEGGVIAVLQSYIDEDKDESFYTVSWACNIDGTPFLVAGGLNGIIRVIDTGNEKIYKSFVGHGDSINEIRTQPLKPSLVVSASKDESVRLWNIHTGICILIFSGAGGHRNEVLSVDFHPSDIYRIASCGMDNTVKIWSMKEFWTYVEKSFTWTDLPSKFPTKYVQFPIFIASVHTNYVDCNRWIGDFMLSKSVDNELVLWEPKMKEQSPGEGTVDILQKYPVPECDIWFIKFSCDFHYKTAAVGNREGKIYVWEVQANPPVLIARLSHIQSKSPIRLTAMSYDGSTILCCCEDGTIWRWDVVASS

SEQ ID NO: 12916 - protein, 218 aa, Corylopsis sinensis
GLVKKAHEISVLCDAEVALIVFSTKGKLFEYSTDSCMEKILERYERYSYAERQLVATDPNSQGNLSLEYSRLKAKVELLQRNQRHFLGEDLDSLSLRELQTMEQQLDTALKRIRSRKNQLMYESISELQKKEKAMQEQNNMLAKKIKEKEKTMTQQAQWEEQNQDPGAASFLLQQPLPCLNIGNTYNQGVGGGAPEVRRNELDLTLEPVYPCHIGCFA

SEQ ID NO: 12917 - protein, 65 aa, Nostoc sp. PCC 7120
MILPGATVRVKNPNDTYYRYEGLVQRVTDGKVAVIFEGGNWDKIITFRLSELELVEITAGKKKGK

SEQ ID NO: 12918 - protein, 502 aa, Oryza sativa; identical to SEQ ID NO: 10274

SEQ ID NO: 12919 - protein, 365 aa, Mycosphaerella graminicola
MPTYNIVVFGGDHCGPEVTAEALKVLDVIDNSNADVHFNIQPHLLGGASIDAHGEPLTDEALAAAKAADAVILGAIGGPKWGTGKVRPEQGILRLRKEMGTYGNLRPCFFASESLVKTSPLKEEVCRGVNFNIVRELTGGIYFGERTEDDGSGYAVDTEPYSRAEIERVARLAGFLALAEDPPCPVWSLDKANVMATSRLWRKTVTDVFANEFPQLKIGHHLIDSAAMLMVKNPRALNGVIVTSNLFGDIISDEASVIPGSLGLLPSASLTASPDGKSKCNGIYEPIHGSAPDISGKGIVNPVAMILSLGMMCKYSLQQPELAKKIDEAVRNVIEKGINTADIGGSAKTAEVGDAIAKELEALLK

SEQ ID NO: 12920 - protein, 420 aa, Listeria monocytogenes EGD-e
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSIESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEVADAKQNEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 12921 - protein, 582 aa, Desulfitobacterium hafniense
MIGEVSMPIIIRFFKDKRFRVIITMFLRFVFQLWWLSKKRRFYGEEAYQKQLKAVYQKQARIFAEIAMGMGGLLIKLGQFFSSRVDILPEEYTRELALLQDAVKPVPTADIIRRIEAEYGRPLGEIYLNFSPEPIASASLGQVHTAEIKGHDQVAVKILRPGIEEIISSDFDALRFVVTFAKRYPRIRAAVDLEQIYAEFTETTLDELDYLKEGRHADQFRENFAGEPGIAVPKVYWEYTTRRVLTMEYITGYKINDFAALDKAELDRVKLADTLITAYVQQFLSDAFFHADPHPGNLLVKEDGTLVFLDFGMVGRIDEGMREELISFVMALFKKDTEQMVEVFANLGFLRPHAEKGTLAKGLKLILANIFAEKDLKKVNSEEFLWELREFMYSQPFQIPARTLFLGKALLSIIGICGGLNPRLDLIKTLRPYAEELLAGKEQADGAQGFAQKFILDQAKKTFTDVVGLPERINHLITGLEGGSIRLHPARSFEQNLLQSQREQGNRIVQAIVSSGFLIAGTILLEGPYLKIGIGLIAFSALSFLSLLKSNAGRARSERRGRGNRAMRNASATGFKKPRFHP

SEQ ID NO: 12922 - protein, 472 aa, Gymnogongrus sp. EstevezJ_28.iv.99
ESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVCERERMDKFGRPFLGATVKPKLGLSGKNYGRVVYEGLKGGLDFLKDDENINSQPFMRWKERYLYSMEGVNRAVAASGETKGHYLNVTAATMEEMYERAEFAKELGSIIIMIDLVIGYTAIQTMAIWSRKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDFVAEGPQILQDAAKTCGPLQTALDLWKDITFNYTSTDTADFVETPTANV

SEQ ID NO: 12923 - protein, 106 aa, Glycine max
  unsure (1)..(106): unsure at all Xaa locations
ISSPTITRCXHSQAGMRTPFTVLKYMASFPTIKTNNDITSITTNGGRVQPMHVMTPLLMNKFKTTXYLPNLDDAQLAKEVXYLLKKVCIPCLEFELDHRFLFLEPN

SEQ ID NO: 12924 - protein, 382 aa, Arabidopsis thaliana
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 12925 - protein, 329 aa, Pseudomonas fluorescens PfO-1
MPLSGCRRSGNVTRPIGQSTLMTSKLEQLKQFTTVVADTGDFEAIARVKPVDATTNPSLLLKAAAIPAYAELLNASVRDCKGDVGLASDRFGVAVGQEILKVIPGRISTEVDARLSFDQDAVLKRAHRLIELYDKAGVGRDRVLIKIASTWEGIRAAEILEKEGIQTNLTLLFSFAQAAACADAGVFLISPFVGRIYDWYKKANGNDYTGADDPGVQSVTRIYNYYKANDYKTVVMGASFRNLSQIEQLAGCDRLTISPDLIEKLAADTGKLERKLAPGHAGEARLSLNEAQFRWLSNEDAMATEKLAEGIRQFARDQEKLEALLQAKL

SEQ ID NO: 12926 - protein, 288 aa, Glycine max
  unsure (1)..(288): unsure at all Xaa locations
LILEIPNWTSGCTESIEKGEQMWVKRIMSQSVLPNHITVLDLLKIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSXGSEENYDGGLLFSWALHQITSRXRTRKVRPPERTESGARSKLLAQCRYRASGPGRVGPAFXGVXPGRFEESVLNFVSKNMSTAXDNFHLVLDSHRWVPLPRV

SEQ ID NO: 12927 - protein, 140 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEESRRST

SEQ ID NO: 12928 - protein, 983 aa, Zea mays
GDDHLAAAAARHRLPPARLLLRRWRGSPPRAVPEVGSRRVGVGVEGRLQRRVSARSVASDRDVQGPVSPAEGLPNVLNSIGSSAIASNIKHHAEFAPLFSPDHFSPLKAYHATAKSVLDALLINWNATYDYYNKMNVKQAYYLSMEFLQGRALTNAIGNLEITGEYAEALKQLGQNLEDVASQEPDAALGNGGLGRLASCFLDSLATLNYPALGYGLRYEYGLFKQIITKDGQEEIAENWLEMGYPWEVVRNDVSYPVKFYGKVVEGTDGRKHWIGGENIKAVAHDVPIPGYKTRTTNNLRLWSTTVPAQDFDLAAFNSGDHTKAYEAHLNAKKICHILYPGDESLEGKVLRLKQQYTLCSASLQDIIARFESRAGESLNWEDFPSKVAVQMNDTHPTLCIPELMRILMDVKGLSWSEAWSITERTVAYTNHTVLPEALEKWSLDIMQKLLPRHVEIIETIDEELINNIVSKYGTTDTELLKKKLKEMRILDNVDLPASISQLFVKPKDKKESPAKSKQKLLVKSLETIVEVEEKTELEEEAEVLSEIEEEKLESEEVEAEEESSEDELDPFVKSDPKLPRVVRMANLCVVGGHSVNGVAEIHSEIVKQDVFNSFYEMWPTKFQNKTNGVTPRRWIRFCNPALSALISKWIGSDDWVLNTDKLAELKKFADNEDLHSEWRAAKKANKMKVVSLIREKTGYIVSPDAMFDVQVKRIHEYKRQLLNILGIVYRYKKMKEMSTEERAKSFVPRVCIFGGKAFATYIQAKRIVKFITDVAATVNHDSDIGDLLKVVFVPDYNVSVAEALIPASELSQHISTAGMEASGTSNMKFAMNGCILIGTLDGANVEIREEVGEENFFLFGAEAHEIAGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 12929 - protein, 513 aa, Pseudomonas aeruginosa PAO1
MNPSLNAFRPGRLLVAASLTASLLSLSVQAATLTRDNGAPVGDNQNSQTAGPNGSVLLQDVQLLQKLQRFDRERIPERVVHARGTGAHGEFVASADISDLSMAKVFRKGEKTPVFVRFSAVVHGNHSPETLRDPRGFATKFYTADGNWDLVGNNFPTFFIRDAIKFPDMVHAFKPDPRSNLDDDSRRFDFFSHVPEATRTLTLLYSNEGTPASYREMDGNSVHAYKLVNARGEVHYVKFHWKSLQGQKNLDPKQVAEVQGRDYSHMTNDLVSAIRKGDFPKWDLYIQVLKPEDLAKFDFDPLDATKIWPGIPERKIGQMVLNRNVDNFFQETEQVAMAPSNLVPGIEPSEDRLLQGRLFAYADTQMYRVGANGLGLPVNRPRSEVNTVNQDGALNAGHSTSGVNYQPSRLDPREEQASARYVRTPLSGTTQQAKIQREQNFKQTGELFRSYGKKDQADLIASLGGALAITDDESKYIMLSYFYKADSDYGTGLAKVAGADLQRVRQLAAKLQD

SEQ ID NO: 12930 - protein, 702 aa, Zea mays
  unsure (1)..(702): unsure at all Xaa locations
MAPSWWGRDARANGVVGGGTPVVVRMENPNWCISEVAAAASEVDAPPPAAAGGGKAGRRGKNARQITWVLLLRAHRAAGRLTGAASAALSVAAAARRRVAAGRTDSDADADAAPGESAALRARSYGCIRLFLALSLLLLAVEVAAYLRGWHLEVDVGAGILAVDGLFAAAYAAWMRARLDYLAPPLQFLTNACVLLFLVQSVDRLVLCLGCFWIKLKGVRPVPPLPADKEDVEAGPDGVPMVLVQMPMCNEREVYQQSIGAVCSLDWPRSNFLVQVLDDSDDATTSALIKEEVEKWQREGVRIVYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPSPKSFPFIVPYLLFENTMSVTKFNAMVSGLFQLGSAYEWVVTKKSGRSSEGDLVALVEKHSKQQRVGSAPNLDALTKESKGTEEEKNKKKRKKKHNRIYRKELALSFLLLTAAARSLLSVQGIHFYFLLFQGXSFLVVGLDLIGEQVE

SEQ ID NO: 12931 - protein, 245 aa, Petunia x hybrida
MGRGRVELKRIENKINRQVTFAKRRNGLLKKAYELSVLCDAEVALIIFSSRGKLYEFCSTSSMMKTLEKYQQCSYASLDPMQSANDTQNNYHEYLRLKARVELLQRSQRNLLGEDLGSLNSKELEQLEHQLDSSLKQIRSKKTQHMLDQLADLQQKEQMLAEANKQLRRKLEESAARIPLRLSWDNGGQPMQHNRLPPQTEGFFQPLGLNSSSPQFGYSPMGANEVNNAVSTAQNMNGFIPGWML

SEQ ID NO: 12932 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 12933 - protein, 441 aa, Pseudomonas syringae pv. syringae B728a
MGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 12934 - protein, 360 aa, Pseudomonas aeruginosa PAO1
MSKQILVLPGDGIGPEIMAEAVKVLELANDRFQLGFELAEDVIGGAAIDKHGVPLADQTLQRARQADAVLLGAVGGPKWDRIERDIRPERGLLKIRSQLGLFANLRPAILYPQLAAASSLKPEVVAGLDILIVRELTGGIYFGQPREQRVLENGERQAYDTLPYSESEIRRIARVGFDMARVRNNRLCSVDKANVLASSQLWREVVEEVAKDYPDVELSHMYVDNAAMQLVRAPKQFDVMVTDNMFGDILSDEASMLTGSIGMLPSASLDANNKGMYEPCHGSAPDIAGQGIANPLATILSVSMMLRYSFSQATAADAIEQAVSKVLDQGLRTGDIWSEGCRKVGTREMGDAVVAALKNL

SEQ ID NO: 12935 - protein, 196 aa, Yersinia pseudotuberculosis
SIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHA

SEQ ID NO: 12936 - protein, 302 aa, Oryza sativa
MVLPVLAPLAGATAVAFLLFKFATVDGCVDHWSQPRDSGQWKSEVLFKSKLPLFSSYTKDKHPNSRVEVLPMDLSSGEESLKEHVHEAESLFSNAGVDYMIHNAAFERPKRRALEETEQGLKATFDVNVFGTITLTRLLAPSMMDRGMGHFVVMSSAAGKVPSPGQALYSASKHALNGYFSSLRSELCTKGIKVTVVCPGPIEAPQSSGATSSSQKPSSETNKRVGSLEKGMELCKGLCSISIMILKRVPVERCAELTIVAATHGLKEAWISYQVGAKRLDVAAKKGNAYGWNLLFGGKKSA

SEQ ID NO: 12937 - protein, 427 aa, Sirodotia huillensis
IEASAAIAGESSTATWTVVWTDLLTACDLYRAKAYKVDAVPNTADQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSMEGVNRAQAAAGEIKGHYLNVTAGTMEDMYERAEFAKELGSIICMIDLVIGYTAIQTMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 12938 - protein, 362 aa, Synechocystis sp. PCC 6803
MSQTYNVTLLPGDGIGPEIMAVAVAVLGKVADQFGFAFNFQEALIGGAAIDATGQPLPEATLAQAKDSDAVLLAAIGGYAWDNLPRSQRPETGLLAIREGLGLFANLRPATIFPQLIDASSLKREVVEGVDIMVVRELTGGIYFGKPKGIFETETGEKRGVNTMAYTVGEIDRIAKVAFETARKRRGQLCSVDKANVLDVSQLWRDRVMAIAVDYPDVELSHLYVDNAAMQLVRSPRQFDTIVTGNLFGDILSDIAAMLTGSIGMLPSASLGSDGPGLFEPVHGSAPDIAGQDKANPLAQVLSAAMMLRYGLDQPQAADRLEDAVKKVLEQGYRTGDILSPGTQLVGCRQMGEQLLSILDEM

SEQ ID NO: 12939 - protein, 212 aa, Bacillus anthracis str. A2012
MGTNKPVVIGIAGGSGSGKTSVTKAIFDHFKGHSILILEQDYYYKDQSHLPMEERLKTNYDHPLAFDNDLLIEHLQQLLAYKQVDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDSMVTKIATILEQKVNL

SEQ ID NO: 12940 - protein, 239 aa, Phalaenopsis equestris
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 12941 - protein, 356 aa, Bacillus sp. UTB2301
MEHQFPKIQIVDENGNIVDSKYEDKLTPEFIKELYERLMFVRTFDRKAISLQRQGRLGTYAPFEGQEAAQVGSALALEKDDWLFPTYRDHAATITFGHKLSTVFLYWNGRVEGCVPPEGKKIFPPAVPIATQLPHATGAAMAEKYKGTKNAAIVYFGDGATSEGDFHEGLNFASVFKAPVVFFNQNNSFAISVPIHKQMNSKTIAQKSVAYGIPGIRLDGNDIFAVYFYTKEALDRARNGEGPTLIEAVTWRYGAHTTADDPTKYRNQEESLERREKYDPILRVERLMKNKGIWDEKWAASVEEKASQTIEEAVKEMEAFPAPDVNDLFDHVFEKPTWTIEEQKQAYFEYLRGEKR

SEQ ID NO: 12942 - protein, 375 aa, Mastocarpus papillatus
VATAGGKFSAMVPSGASTGIYEALELRDGDKSSYLGKGVDKAVANVKDKISEAIMGMDASDQGAVDAKMIELDGTEGGFKKNLGANAILGVSMAVARAGANAKGVPLYKHLNNLAGNPKMLLPVPSLNVINGGTHAGNKLAMQEFMILPVGASTFREAMKMGAETYQYLKKVIKKKYGLDATSVGDEGGFAPNIQDNTEGLKLLEEAIEMAGYTGKIKVGMDVAASEFWKEDKEVYDLDFKNDDNDGSQCLTGEKLGEMYKDFISNFPMISIEDPFDQDDWESYAKLTAAVGEGVQIVGDDLLVTNPNRIQTGIDKKACNALLLKVNQIGSITEAIQASKMSRDAGWGVMVSHRSGETEDNFIADLCVGLGTAQI

SEQ ID NO: 12943 - protein, 241 aa, Zea mays
  unsure (1)..(241): unsure at all Xaa locations
MGRGRVELKRIENKINRQVTFAKRRNGLLKKAYELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKXEQMFCEANKCLRRRLEESNQVIRQHAWEQXERHFEVQPQQLNGNNFFHPLDGAGEPPLQIGYPSEALTSSCMTPFLPPWLP

SEQ ID NO: 12944 - protein, 345 aa, Vibrio parahaemolyticus RIMD 2210633
MLKVAINGFGRIGRNVLRAVYESGKHQQIKVVAVNELAQPEAMAHLLQYDTSHGRFGKKISHDQEHLNVHHESGEYDAIRILHLSEIELLPWRDLEVDIVLDCTGVYGSKADGLAHIEAGAKKVLFSHPGANDLDNTIIYGVNHETLKDEHRVVSNGSCTTNCIVPIIKVLDEAFGIESGTITTIHSSMNDQQVIDAYHNDLRRTRAASQSIIPVDTKLHKGIERIFPKFSNKFEAISVRVPTVNVTAMDLSVTINTNVKVNDVNQTIVNASQCTLRNIVDYTESPLVSIDFNHDPHSAIVDGTQTRVSNGQLVKMLVWCDNEWGFANRMLDTALAMKASSQVEL

SEQ ID NO: 12945 - protein, 158 aa, Xanthomonas axonopodis pv. citri str. 306
MNIVRYPQFPTHALQNEIKHVFDRFFEQNGDTDESAVVTAQWVPRVDIKEEVNHFVLYADLPGIDPSQIEVQMDKGILSIRGERKSESSTETERFSRIERRYGSFHRRFALPDSADADGITAAGRNGVLEIRIPKRPAATPRRIQVGNGQNTSGSTVQ

SEQ ID NO: 12946 - protein, 427 aa, Paralemanea annulata
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDINLPHGIFFEQNWASLRKVTPVASGGIHCGQMHQLLDYLGDDVVLQFGGGTIGHPDGIQAGATANRVALESMVIARNEGRDFVTEGPQILRDAAKTCGPLQTALDLWKDISFNYTSTDTADFV

SEQ ID NO: 12947 - protein, 511 aa, Oryza sativa
MAGGGVAALGVKKERAAEYKGRMTLAVGMACLVAAVGGAIFGYDIGISGGVTSMDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 12948 - protein, 523 aa, Zea mays; identical to SEQ ID NO: 4151

SEQ ID NO: 12949 - protein, 314 aa, Nostoc sp. PCC 7120
NGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWG

SEQ ID NO: 12950 - protein, 201 aa, Triticum aestivum
MAEAAALEGSEPVDLTKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYSAFENIYPVLTEFRKVQQ

SEQ ID NO: 12951 - protein, 99 aa, Triticum aestivum
MPRAEVAFAMHAGDGEVEAGFAKLQGEDFEYYMQTYSIMLGRSSKKSMVDVDLSSLGGGMNISRHHARIFYDFQRRRFALDVIGKNGCHVEGVLHLPGN

SEQ ID NO: 12952 - protein, 99 aa, Zea mays
  unsure (1)..(99): unsure at all Xaa locations
MSGAAEENKKTPEGGCHILLRXKGPDGSDGFFRIXHSTHLTNLMNAYWDRQPADVNAIACLFDDPMLHTEYTPDDLYMEDGDNIHAMLHLTGGSVPSTT

SEQ ID NO: 12953 - protein, 187 aa, Triticum aestivum
MECSGDEVVELNCARAGGDPGEYAAVLKRKLQLYCAAVAKTMEGKPQESSLNCLSSQASDTSPLVSQASFDCDGTVVQGKPANSCTSKEQSDDDDGDLEENTDPASAKRVKRMLSNRESARRSRKRKQAHQNDIESQVTQLRAENASLLKRLTDMTQKYKEASLGNRNLTVDIETMRRKVYPFLDNS

SEQ ID NO: 12954 - protein, 196 aa, Zea mays
  unsure (1)..(196): unsure at all Xaa locations
MVEQGKPRSIPTKAKKSPFVEVGVDEIGQASGVVFARESPLAPKSDQGCSVSHSHGDDETQESDGCVQSQGLDEHGWVDFGSLXQLVLFSRQWSLAESLVDLADQQPMLDYGLSIALDAIWFLRTKQDLEGLNSLISKIVASGAKDFARAILRTSLLASCVAACQSKAITVGNSQEIVPERMHDRLRDCPGAEHLK

SEQ ID NO: 12955 - protein, 348 aa, Pseudomonas putida KT2440
MSRFWSPFVKDLVPYVPGEQPKLARLVKLNTNENPYGPSPKALEAMRGELNDNLRLYPDPNGDRLKQAVAEYYGVTPAQVFVGNGSDEVLAHIFHGLFQHDAPLLFPDISYSFYPVYCGLYGIAFEQVALDEQFQIRIEDYKKPNAGIIFPNPNAPTGCLMPLQAVEELLQANRDSVVVVDEAYIDFGGETAISLVDRYDNLLVTQTLSKSRSLAGLRVGLAVGHPDLIEALERIKNSFNSYPLDRAAIVGAAVAFEDREYFEETCRKVIDSREVLVGQLQAKGFEVLPSAANFIFARHPQQDAGELAARLREQGVIVRHFKQPRIAQFLRITIGTPEMNQALLDALS

SEQ ID NO: 12956 - protein, 228 aa, Bacteroides thetaiotaomicron VPI-5482
MKGDIKKIHPEYVMSEIDKLASDDAIFTVDTGMTCVWGARYLQATGKRHMLGSFNHGSMANALPQAIGAALAYPDRQVVALCGDGGLSMTLGDLETVVQYKLPIKIIVFNNRSLGMVKLEMEVDGLPDWQTNMLNPDFAQVAEAMGMTGFNVSNPEEVLTTLLNAFELDGPVLVNIMTDPNALAMPPKIELGQMVGFAQSMYKLLINGRSQEVIDTINSNYKHIREVF

SEQ ID NO: 12957 - protein, 255 aa, Yersinia pestis CO92
MRHPLVMGNWKLNGSTHMVNELIAGLRKELSTVDGCGVAIAPPAIYLNQAKHELAGSRIALGAQNVDVNLSGAFTGETSAEMLKDIGAQYIIIGHSERRTYHQESDELIAKKFGVLKEIGLIPVLCIGESEAENEAGQTEAVCAKQLDAVLNTLGVKAFEGAVIAYEPIWAIGTGKSATPAQAQAVHKFIRDHIAKQDAAVAAQVIIQYGGSVNDKNAAELFTQPDIDGALVGGASLKADAFAVIVKAAAKAKKA

SEQ ID NO: 12958 - protein, 128 aa, Oryza sativa
  unsure (1)..(128): unsure at all Xaa locations
LAYKRAHHNNHYDGAINNMHRDEEERYYPXSHAPLRHAPPTPITPRPEVGRRQKATIHKQNEHSQXGERHRSRAPDRQGRKKRRFAGELAHPKVSARDCSTYRVNYLSQSDELVKAKTEARDAVKPSM

SEQ ID NO: 12959 - protein, 495 aa, Pseudomonas fluorescens PfO-1
MAIQEKRSRKMAGAQTHMHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARHGQHL

SEQ ID NO: 12960 - protein, 330 aa, Ferroplasma acidarmanus
MLDLQKLRYGDELLKRGFAKMTKGGVVMDVTNAEQAKIAEKAGAVSVMALERVPSDIRAQGGVARMSDPLKVKEILDSVSIPVMAKVRIGHLSEASILESLGVDMLDESEVLTPADPFYHINKKMYKVPVVCGARTFPEAVRRIFEGAAMIRTKGEAGTGNIIEAVRHIRTVNDGIYILNSITSDEMYAVAENISKSYTTLRNLTASDLYGADKEMPYDNVYYGMDFREISNQIYKVLKEIKHLKRLPLVNFAAGGIATPADAALMMKMGMDGVFVGSGIFKSRDPQKMAEAIVEATENYEDYKLLSDVSSGLEGMHGLDISEIEKLQNR

SEQ ID NO: 12961 - protein, 288 aa, Oryza sativa (japonica cultivar-group)
MACSHLAAAAAAASPAAARSPAASSAATASAFARLSATPRVASGGLAVRGQRGVAAVVAAAAGAAAATPVADIEERRATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVRYDEELGKALFNGLPNPFTAARYHSLVIEQETFPHDALEATAWTEDGLIMAARHKKYRHIQGVQFHPESIITPEGKRIILNFVRFIEELEKQRAGEKN

SEQ ID NO: 12962 - protein, 288 aa, Escherichia coli
IGQALALLLKTQLPSGSELSLYDIAPVTPGVAVDLSHIPTAVKIKGFSGEDATPALEGANVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEKNALEGMLDTL

SEQ ID NO: 12963 - protein, 463 aa, ASPERGILLUS NIDULANS FGSC A4
MTDSKTAAPKGPNQDDRPASPAAGELVPGIDMEHYRNTVPLWKRVWQHSLTQMMLLSIQAFCGPAMSDAIAGLGGGGLATPKVSNISNAINYAMLAIVCFLGGPLVNKIGVKWALVLGSMSFPIQGSAYYCNSKFGNQWYLIFSGAISGAGTACWYVAEAGCIMTLAPSGARGKYLALWIVSRNLGQLVGGAINLSKNHVEGADGGITPDTYIAFVIIECLALPFALLIAPFERVVRSDGTKIVMAETLSTKREFKQILKTMTSRLILLSGIWALWSFFYSCVSLSPLRRTYFSVRARALSSLISPFFCIVGCFGLGFILDMKGFSQRRRAQMGLYTVVILNVGVYIWSIIMQNKFNHHNPGHIDWNDGLYPSSFLPYFFVQTTGPLSQSYMYWLLSSFATDAQANVRNGAMFRCIEAIGQAIAYGMNTQTDSNPLIGFTPDQIPADVVAQEQNAALAKAEDV

SEQ ID NO: 12964 - protein, 422 aa, Oryza sativa
  unsure (1)..(422): unsure at all Xaa locations
EDLVCPRTRLQNAVWSWLYKWVEPVMSSWAMSKLRGRALDRLMXHIHYEDENTQYLCICSVNKGLXALNMVCCWAEDPNSDAFKQHLARVPDFLWLSEDGMKAQVYDGCQSWETAFIIQAFCATDLVNEYASTVQRAHEFLKNSQVVRNHPGDQSYWHRHRSKGSWTLSSADNGWAVSDTTAEALKNKDGTVSTYECKRTSTWIEILNPCESFSNMVVDYPYPECTSSVLQALVLFKELCPGYRTEEIEKCVRNATMFIENTQGEDGSWLGTWGVCFTYGAFFSVKGLIAAGRTYENSSSIRKACDFIMSKQLNTGGWGESHVSNETKVYVNIKGDHAHAVNTAWAMLTLIYAGQMERDPAPLHCAAKELINMQLETGEFPQQEHVGCFNCSLFFNYPNYRNLFPIWALGEYCNRLRSERRA

SEQ ID NO: 12965 - protein, 256 aa, Brucella suis 1330
MTKFWIGTSWKMNKTLAEARLFAEALKAADAGRSPDIQRFVIPPFTAVREVKEILSGTSVKVGAQNMHWADQGAWTGEISPLMLKDCNLDIVELGHSERREHFGETNETVGLKVEAAVRHGLIPLICIGETLEDRESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 12966 - protein, 404 aa, Haemophilus influenzae Rd
MLTLDQARSKMLEQLPFPTQTEYLNLQEAANRICAEDIISPINVPSFDNSAMDGYAVRLSDLQQSLTLSVAGKSFAGNPFQEEWPSKSAVRIMTGAMIPEGTDAVIMQEQVTLNEDGTITFSELPKPNQNIRRIGEDVKKGDVVLEQGAQLTPVSLPLLASLGIAEVKCYRQLKVGVLSTGDELVEVGKPLQSGQIYDTNRFTVKLLLEKLHCEVIDLGLLPDNEAEFEKAFIAAQSQADLVITSGGVSVGEADFTKAVLEKVGQVNFWKIAIKPGKPFAFGKLENAWFCGLPGNPVSALVTFYQLVQPLIAKLQGQKQWKKPPHFSAIATMNLKKAVGRLDFQRGFYYINEQGQIEVQSVGFQGSHLFSAFVKSNCFIVLEQERGNVSAGETVTIEPFNHLLG

SEQ ID NO: 12967 - protein, 831 aa, Paenibacillus sp. TS12
MAQLTLEEKAGLCSGESFWRTKAIDRLGIPSIMMTDGPHGLRKQAGEADHLGLNESIPATCFPTAAGLASSWDRELVRKVGEALGKESQAENVSILLGPGANIKRSPLCGRNFEYFSEDPYLTGELAAAHIAGVQSQGVGTSLKHFAVNNQEHRRMTTDAVVDERTLREIYLTGFEIAVKKSQPWTVMSAYNRMNGTYCSENETLLTRILKEEWGHEGIVVSDWGAVNEAAASVAAGMELEMPSSHGIGQRKIVAAVESGELSVEALDRAVTRLLTVIFKAVDSRKTDATYDKEAHHLLAREIARESMVLLKNEGNLLPLAKTGKLAIIGAMAEQVRYQGGGSSHIKPTKLDSIRDEIEKSARSAEIRYSKGYLLESDESDESLLNEAKQAAADSDVAVLFVGLPDRYESEGYDRTHLNLPANHIELIERIASVQPNVVVILSNGSPVVMPWLGHAKAVLEAYLGGQAAGGAIADLLFGDANPSGKLAETFPHSLKHNPSHPFYPGEGDRTEYREGIFVGYRYFDAKDIEPLFPFGHGLSYTAFSYSGLKLDKSEMTDRDIVQVRVNVKNTGGRFGKETVQLYVHSRNSSVIRPEKELKGFAKVSLNPEEEQTVTFALDKRSFAYYNAELKEWHAETGEYEILIGSSSRDIALRTALTVQSTTEIVPTFHRNTTLGELMENPATLPILAHLQSMAPQQQAQSDSVSPDMMMAMMRYMPLRALLPFTGGAMTEETLGMLLEQFNQAVRGEKNQPHASEGSSAAFNEYSTLGDLLAHEAAVAVLEKHLPGISTNPMISMGKGLTLKQLAGIPQANIPEELISTIVTDLSVVRG

SEQ ID NO: 12968 - protein, 503 aa, Pisum sativum
MAITVSSRQLFIDGEWRVPILNKRIPNINPSTENIIGDIPAATKEDVDLAVDAAKRAISRKNGRDWSAASGSLRARYLRAIAAKIKEKKDELGKLESIDCGKPLEEALADLDDVVACFEYYAGLAEELDSKQKAPISLPMDTFKSYILKEPIGVVALITPWNYPFLMATWKIAPALAAGCAAILKPSELASVTCLELGEICKEVGLPRGVLNIVTGLGHEAGASLASHPDVDKISFTGSSATGSKIMTTAAQLVKPVSLELGGKSPIVVFEDVDLDKVAEWTGFGCFFTNGQICSATSRLIVHESIAVEFVDKLVKWAENIKISDPLEEGCRLGPIVSEAQYKKVLNCISSAKSEGATILTGGRRPEHLKKGYFVEPTIITDVTTSMQIWREEVFGPVLAVKTFSTEEEAINLANDTHYGLGSAVMSNDLERCERLSKALQAGIVWINCAQPSFIQAPWGGIKRSGFGRELGEWGLENYLSVKQVTRYTSDEPWGWYQPPSKL

SEQ ID NO: 12969 - protein, 84 aa, Glycine max
  unsure (1)..(84): unsure at all Xaa locations
DHGSVTHIPSWGKFWLSVLGVVDRCGINPLPPEFWILPTFSPMXPAKMWCYCRLIYMPMSYXYGKKFVGSITPLVLNLREELFT

SEQ ID NO: 12970 - protein, 347 aa, Mycobacterium tuberculosis CDC1551
MMVSPATTATMSAWQVRRPGPMDTGPLERVTTRVPRPAPSELLVAVHACGVCRTDLHVTEGDLPVHRERVIPGHEVVGEVIEVGSAVGAAAGGEFDRGDRVGIAWLRHTCGVCKYCRRGSENLCPQSRYTGWDADGGYAEFTTVPAAFAHHLPSGYSDSELAPLLCAGIIGYRSLLRTELPPGGRLGLYGFGGSAHITAQVALAQGAEIHVMTRGARARKLALQLGAASAQDAADRPPVPLDAAILFAPVGDLVLPALEALDRGGILAIAGIHLTDIPDLNYQQHLFQERQIRSVTSNTRADARAFFDFAAQHHIEVTTPEYPLGQADRALGDLSAGRIAGAAVLLI

SEQ ID NO: 12971 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 12972 - protein, 455 aa, Gracilaria sp.
VVKDTDILALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAIAASGEVKGHYMNVTAATMEDMYERAEFAKQLGTVIIMIDLVIGYTAIQTMAIWARRNDMILHLHRAGNSTYSRQKIHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILLDAAKTCGPLQTALDLWKDITFNYTSTDTADFVETPTANV

SEQ ID NO: 12973 - protein, 317 aa, Escherichia coli O6
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAVDQEKLEKMIGDLL

SEQ ID NO: 12974 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIKPCSEKGTXXXVRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 12975 - protein, 432 aa, Arabidopsis thaliana
MAIKDLTATTGDSSLPLIKSPPSETTGGDRTSALQTLGNIIVSIVGTGVLGLPYAFRIAGWLAGSLGVIIVGFATYYCMLLLIQCRDKLESEEGEEESKTYGDLGFKCMGTKGRYLTEFLIFTAQCGGSVAYLVFIGRNLSSIFSSYGLSMVSFILILVPIEVGLSWITSLSALSPFSIFADICNIIAMCFVVKENVEMVIEGDFSFSDRTAISSTIGSLPFAGGVAVFCFEGFAMTLALESSIREREAFPKLLAKCLPGLRLSMCCSGFVLIWHYGDQTKNIITLNLPNNWSAIAVQIGLCVGLTFTFPIMVHPLNEIIEQKLKRIDWLQKHHNGYSNETGSVSKFAIFTTRTLLVVGLAAIASLVPGFGTFASLVGSTLCALISFVLPASYHLTLLGPSLNVWNKSIDVFIVICGLIFAVYGTYNTIVGV

SEQ ID NO: 12976 - protein, 672 aa, Zea mays
MAGDRGRGAAERVDAAVGAVGSGGWEFRNAYRRQLLALSRRIRLLGPFAEELREARRGSAEQEEQERALAPLADALEEALDLLQLGRDGSRIFLVLPTAPATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 12977 - protein, 147 aa, Nostoc punctiforme
MSDWLEHTVQVEVEAPIDLVWSLWSDLEQMPRWMKWIDSVKIPPDNPDISLWKLKTGSLEFNWQSRILKVIPNQIIQWESIDGLPNQGAIRFYDRHNSSIVKMSISYAIPGMIGKIMDNLFLGRIVESTIQADLERFKEYALNVKAN

SEQ ID NO: 12978 - protein, 479 aa, Pseudomonas putida
MSKILTTASGAPVADNQNSRSAGPRGPLLLDDFHLIEKLAHFNRENIPERRVHAKGSGAYGTFTVTRDITGYTSAKLFEQVGKQTETFLRFSTVGGERGSADTERDPRGFAVKFYTEEGNWDIVGNNTPVFFIRDPLKFPDFIHTQKRHPQSNLKNAQIFWDSWSHSPEALHQVTILFSDRGIPDGYRHMHGFGSHTYSLINAQGERTWVKWHFKTQQGIKNLAPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYAAAPKQSPRHAEPALALNGSADRYDHREDADYYSHAGALFRLMSDEQKALLISNIAGTMAGVSENVIQRQLQYFFKADPAYGEGIAKGLGINLA

SEQ ID NO: 12979 - protein, 123 aa, Zea mays
MQAVGIRRGLTIDPAGEEEAPAARVWRLVRESPVVIFARRGCCMAHVMRRLLAAVGAHATVIEVDAGAAEEQELAAAVEGGGGGGVPALFVGGDPVGGLEGLMGLHLSGRLVPRLRELGALCA

SEQ ID NO: 12980 - protein, 373 aa, Methanothermobacter thermautotrophicus str. Delta H
MKLKSGSMVKIRNKINDIEPYVPGRSIKEIADAYGLKEDEIIKLGSNENPLGPSPAAVEAMERELESVHRYPESALTDLREAIADYAGVGMDQVIVGGDGADEIIDVLGRTFLEPGESFVVPMPSYMYYEYTLQAHDARAVHARWDVNENRLDLESVLDAVDESTRLVFLCTPNNPTGGLIDKKDIRAVLESTDTLVVVDEAYTEFAGVDNTDLLPDHENLFILRTFSKVMGLAGMRIGYGLGDPQIIEYMHRVKPVFSLTRLSHAAALATIRDRDYIKKSTEYSIKSREYLYSGLKKFPELRVFRSYANYILIDVRGTGRTAAELSEELLRKGIIVRDCTSFTGLDEYWIRVSVGTLEEDRRFLEVLGELVQ

SEQ ID NO: 12981 - protein, 106 aa, Oryza sativa
VSRTQGGGQLKQMLRRCSSSLGIKGAGGDDDGLPGDVPRGHFAVYVGISRRRYIVPVACLAAPEFQELLRKAEEEFGFDHDMGITLPCDEATFHGVLASASATSIR

SEQ ID NO: 12982 - protein, 123 aa, Triticum aestivum
  unsure (1)..(123): unsure at all Xaa locations
MAPTVMASSATSVAPFQGLKSTAGLPVSRRSNGASLGSVSNGGRIRCMQVWPIEGIKKFETLSYLPPLNTEALLKQVDYLIRSKWVPCLEFNKVGFTSVKHNASPGYXXAGYXTMWETAXFSG

SEQ ID NO: 12983 - protein, 406 aa, Streptomyces avermitilis MA-4680
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 12984 - protein, 141 aa, ASPERGILLUS NIDULANS FGSC A4
MAANAKVPRNFRLLEELEKGEKGLGAEACSYGLADGEDMMMSNWNGTVLGPPHSVHENRIYSLNIHCGPEYPDQPPTLQFISRVNLPCVDAHSGKVDPSKLPCLAQWKRDYTMETVLIELRRYMALPQHKKLPQPPEGSTF

SEQ ID NO: 12985 - protein, 507 aa, Arabidopsis thaliana
MAVVISSNGNSKSFDAKMTVYVFICVIIAAVGGLIFGYDIGISGGVTAMDDFLKEFFPSVYERKKHAHENNYCKYDNQFLQLFTSSLYLAALVASFFASATCSKLGRRPTMQLASIFFLIGVGLAAGAVNIYMLIIGRILLGFGVGFGNQAVPLFLSEIAPARLRGGLNIVFQLMVTIGILIANIVNYFTSSIHPYGWRIALGGAGIPALILLFGSLLICETPTSLIERNKTKEGKETLKKIRGVEDVDEEYESIVHACDIARQVKDPYTKLMKPASRPPFVIGMLLQFFQQFTGINAIMFYAPVLFQTVGFGNDAALLSAVVTGTINVLSTFVGIFLVDKTGRRFLLLQSSVHMLICQLVIGIILAKDLDVTGTLARPQALVVVIFVCVYVMGFAWSWGPLGWLIPSETFPLETRTEGFALAVSCNMFFTFVIAQAFLSMLCAMKSGIFFFFSGWIVVMGLFALFFVPETKGVSIDDMRDSVWKLHWYWKRFMLEEDEHDVEKRTD

SEQ ID NO: 12986 - protein, 493 aa, Oryza sativa
  unsure (1)..(493): unsure at all Xaa locations
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAAXLPLDEKREAAHLKTMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 12987 - protein, 540 aa, Oryza sativa
MAVSLLPAVLVLLAIVAPLLYLVLLPAVKYTTRNGAARWEDDGGDGRRRRRLPPSPRGLPLLGHLHLLGALPHRALRSLAAAHGPVLLLRLGRVPVVVVSSAAAAEEVMRSRDMEFASRPRMAMAELLLYGGRDVAFAPYGEYWRQARRICVVHLLSARRVLSFRRVREEEAAALVGRVRAAAADVVVDLSDLLIAYSNTVLTRIAFGDESARGGGGGGDRGRELRKVFDDFARLLGTEPMGELLPWFWWVDALRGIDGKVQRTFEALDGILERVIDDHRRRREGGRRMDDDGGGDHRDFVDVLLDVNETDKDAGIQLGTVEIKAIIMDMFVGGSDTTTTMMAWTMAELINHPRAMRKAQNEIWAVVGNTSHVTKDHVDKLPYLKAVFKETLRLHPPLPLLIPREPPADTQILGYTIPAHTRVVINAWAIGRDAAAWGQQPDEFSPEKFLNSTIDYKGQDFELLPFGAGRRGCPGIVFGVSAMEIALASLLYHFDWEAAATDHRRRGSQAWALPVDMSEVNGIAVHLKYGLHVVAKPRMP

SEQ ID NO: 12988 - protein, 296 aa, Escherichia coli
  unsure (1)..(296): unsure at all Xaa locations
MVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVAALEKNGTNMKLLAERRAGVLHSGLSRXFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTANVSWSRGLKIRSVFLRW

SEQ ID NO: 12989 - protein, 350 aa, Zea mays
  unsure (1)..(350): unsure at all Xaa locations
VAPSLCDCVRVRVRVRSGFGRIGRLVARVALQSXDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIXLGSTGAAXKAVGKVLSXICNGKLTGMSFRVPTVDVSVVDLTVRIEKGASYEDIKKAIKAASEGPLKGIMGYAEEDLVSTDFLGDSRSSIFDXAKAGIALNDHFVKLVSWYDNEWGYXSNRVVDLIRHMFKTQ

SEQ ID NO: 12990 - protein, 335 aa, Enterococcus faecalis V583
MGKVVTLGEIMLRLSTPVGIRVAQTENFAVHYGGGEANVAISLANYGHQVTFASKVPDNSLGEAAKKHLSRYGVSTEFVRTGGTRLGTYYLETGTGERAASVVYDRAYSSFAQIEEMEWDLHELFSGVEIFHISGITAALSKNWQSMTVALVKAAKQAGCQVSFDINYRGKLWSQKEASVALKAILPFVDICSAGVLDARYLLEIPEPEEELEDALTWYYRKMQERYPNIQVFYSTKRQVHSATDNELIGTLWYKGAYYTSKCHRLQPIVDRVGAGDAFAGGVLHGILAAYDPQTCIDFATAASALKHTVHGDCNQFSQKEVLAFLATGSGKINR

SEQ ID NO: 12991 - protein, 444 aa, Listeria monocytogenes EGD-e
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAVTACDSIQTFKLVVKTIARKHGLHATFMPKPLFGVNGSGMHFNMSLFNEKGNAFFDESGELELSQTAYHFLAGMLKHARGYTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIKAGLGEHIFEHFIEAKTIECDMFRTAVHPWEREQYLEIY

SEQ ID NO: 12992 - protein, 74 aa, Populus x canescens
CMPGMTGYELLKKIKESSSFREIPVVIMSSENVMARIDRCLEEGAEEFIAKPVKLSDVKRLRDYYMASREVRSV

SEQ ID NO: 12993 - protein, 123 aa, Triticum aestivum
  unsure (1)..(123): unsure at all Xaa locations
MAPTVMASSATSVAPFQGLKSTAGLPVSRRSNGASLGSVSNGGRIRCMQVWPIEGIKKFXTLSYLPPLKHGXLLKQVRLXLXRSKWVPCLEFNKLGSXSRXAQRTPGVXNGRYXTMWXLPXXR

SEQ ID NO: 12994 - protein, 415 aa, Osmundea pinnatifida
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLVVERERMDKFGRPFLGATVKPKLGLSGKNYGRVVYEGLKGGLDFLKDDENINSQPFMRWKERFLYSMEAVNRSIAGTGEVKGHYMNITAATMEEMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLKQNLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITF

SEQ ID NO: 12995 - protein, 358 aa, Zea mays
  unsure (1)..(358): unsure at all Xaa locations
MSPTEEAAGGGGDDYDRLSELKAFDDSKAGVKGLVDAGVTTIPAIFRGHLLQXRAEVAREEVVAQLKAAAETVGFFQLVNHGVPSELLCEMLPSVRRFNEEPHEVKRPYYTRDARRKVRFNSNFDLFQSPAANWRDTLFCEAAPEPPRAEELPVAVRHVMLEYGGAVREVAARVLGLLSEALGLSPGHLAGMGCAEGLSLVCNYYPPCPEPDLTLGCSRHSDPSFLTVLLQDSHAQGGLQALLASRWLDVPPVAGALLVNVGDLLQLVSNGRFKSVEHRVVANRSRDTARVSVACFCNADIARSTRLYGPIAELIAADDSDGAGRALYRNVTVPEFLAHYDKKGLDGRPALHRFQLLQ

SEQ ID NO: 12996 - protein, 114 aa, Oryza sativa
QLAKKLQMRMASAGGSRQKAVVAADDCCSTASLSLAGKGHCAVYTADGARFEVPLPYLGTPLFGELLTMSREEFGFAGDDGRITLPCDASVMEYVMCLLSRDASEEVERAFLSS

SEQ ID NO: 12997 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 12998 - protein, 253 aa, Oryza sativa; identical to SEQ ID NO: 7171

SEQ ID NO: 12999 - protein, 395 aa, Oryza sativa (japonica cultivar-group); identical to SEQ ID NO: 657

SEQ ID NO: 13000 - protein, 298 aa, Bifidobacterium longum DJO10A
MKGIILAGGSGTRLYPLTTVTSKQLLPVYDKPMIYYPLSVLMMAGIRDILIISTPKDLPNFERLLGDGSQYGVSFSYKVQPSPDGLAQAFILGEEFIDGEPCALVLGDNIFYGNGLGRTLRKAATVEHGATVFGYYVDDPERYGVVEFDENKKAISIVEKPEHPASNYAVTGLYFYDERVTEFAKQVKPSPRGELEITDLNKMYLEDGTLNVQTLGRGYAWLDTGTMDSLYEAGEFVRTVQRAQGLPIAVAEEIAFENGWITRDELMEAAVKYGKSPYGKHLKDVAENKIIVKPRDVR

SEQ ID NO: 13001 - protein, 389 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 13002 - protein, 123 aa, Glycine max
NSASGGDAPSRDFDTPTLDLVSTTLLHAIFEHGGYTCLSMATLAENGDIRTAEAACERAWHSVLSVWREAYSMACLLVTRHHYRNGEFRDTLRVLDLGIIMGGTLLRKDLDSAIEKISEQTRK

SEQ ID NO: 13003 - protein, 245 aa, Capsicum annuum
MGRGRVELKRIENKINRQVTFAKRRNGLLKKAYELSVLCDAEVALIIFSNRGKLYEFCSTSSMVKTIEKYQRCSYATLEANQSATDTQNNYHEYLRLKARVELLQRSQRNFLGEDLGTLSTKDLEQLENQLESSLKQIRSRKTQFMLDQLADLQQREQMLAESNRLLRRKLEESTAGFPVRLSWEDGADQAMHQHNRLPHTEGFLQPLGLHSSPPHFGYNPVNTDEVNAAATAHNMNGFIHGWML

SEQ ID NO: 13004 - protein, 246 aa, Glycine max
  unsure (1)..(246): unsure at all Xaa locations
YDSRTTIFSPEGRLYQVEYAMEAIGNAGTAIGILSKDGVVLVGEKKVTSKLLQTSTSTEKMYKIDDHVACAVAGIMSDANILINTARVQAQRYAYAYQEPMPVEQLVQSLCDTKQGYTQFGGLRPFGVSFLXAGWDKNFGFQLYTSDPSGNYGAWKAAAIGANNQAAQSILKQDYKDDITREEAVQLALKVLSKTMDSTSLTSEKLELAEVFLSPSGKVKYEVCSPEALTKMLVKSGVTQPATDTA

SEQ ID NO: 13005 - protein, 98 aa, Buchnera aphidicola
  unsure (1)..(98): unsure at all Xaa locations
LPSASLNXSNFGLYEPAGGSAPDIAGKNIANPIAQILSIAMLVRYTMKLPMISDHIESAVIDTLKKGYRTLDIANDKEXYVSTNDIGDIISDILKKRI

SEQ ID NO: 13006 - protein, 147 aa, Glycine max
  unsure (1)..(147): unsure at all Xaa locations
MFIENFKVESPNVKYTETEIQSVYNYETTELVHENRNGTYQWIVKPKSVNYQFKTNTHVPKLGVMLVGWGXGNNGSTLTGGVIANREGISWATKDKIQQANYFGSLTQASAIRVGSFQGEEIYAPFKSLLPMVNPDDIVFXGWDINN

SEQ ID NO: 13007 - protein, 479 aa, Caulobacter crescentus CB15
MREYTKFYIDGAWVDPAAPNTLDVINPATEEVCGVISMGSEADVDKAVRAARKAFASFSQTSREERIDILERIIAEYQKRFEDMAKAITEEMGAPAWLAQRAQAAMGIGHVQTAAAVLKGYKFEEDRGTTRIVKEPIGVCAFITPWNWPVNQIACKVGPAIATGCTMVLKPSEIAPFSGYIWTEIMHAAGVPAGVFNLVNGDGPTVGAALSRHPEVDMVSFTGSTRAGIEVAKNAAPTVKRVHQELGGKSPNIILDDADFSRAVAGGVASVMMNSGQSCNAPTRMLVPGARMDEVIAIAKAAAESHTVGDPNGNHKMGPVVSETQWNKIQGLIQKGIDEGATLVTGGVGRPEGLDKGYYVKPTVFANVTNEMTIAKEEIFGPVVSILGYDTVDEAVTVGNDTEYGLAAYVSGGDQDEVRKVASRLRAGQVTLNGAGPDLMAPFGGYKMSGNGREWGDHAFGEFLETKAILGYSAKVAAE

SEQ ID NO: 13008 - protein, 518 aa, Arabidopsis thaliana
MESCFPAMKLNQCTFGLNNEIVSERVSAFWGTQVVKPNHLRTTKLRSAPQKKIQTNLIRSVLTPFVDQESHEPLLRTQNADPKNVASIILGGGAGTRLFPLTSKRAKPAVPIGGCYRLIDIPMSNCINSGIRKIFILTQFNSFSLNRHLSRTYNFGNGVNFGDGFVEVLAATQTSGDAGKKWFQGTADAVRQFIWVFEDAKTKNVEHVLILSGDHLYRMDYMNFVQKHIESNADITVSCLPMDESRASDFGLLKIDQSGKIIQFSEKPKGDDLKAMQVDTSILGLPPKEAAESPYIASMGVYVFRKEVLLKLLRSSYPTSNDFGSEIIPLAVGEHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTKIKNCIIDKNAKIGKNVVIANADGVEEGDRPEEGFHIRSGITVVLKNATIRDGLHI

SEQ ID NO: 13009 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 13010 - protein, 235 aa, Zea mays
AISAVESGDTFVGVKQNTRPIIVIDNYDSFTYNLCQVKAIFFLTFVYMQYMGEVGANFEVYRNDEITVEEIKKISPRGILISPGPGTPQDSGISLQTVTELGPSIPLFGVCMGLQCIGEAFGGKVVRSPYGVVHGKGSLVHYDEKLDGTLFYDIPNPFQAGRYHSLVIEKDSFPHDTLEIVAWTDDGLIMAARHRIYKHIQGVQFHPESIITTEGRLMVNNFIKIIEGYEASNCS

SEQ ID NO: 13011 - protein, 183 aa, Glycine max
QPTSIVSYNHLGNNDGMNLSAPQTFRSKEISKSNVVDDMVNSNAILYEPGEHPDHVVVIKYVPYVGDSKRAMDEYSSEIFMGGKNTIVLHNTCEDSLLAAPIILDLVLLAELSTRIEFKAENEGKFHSFHPVATILSYLTKAPLVPPSTPVVNALSKQRAMLENILRACVGLAPENNMILEYK

SEQ ID NO: 13012 - protein, 313 aa, Yersinia pestis KIM
MKTNRLNLCCVMSTAVSSEFANTRRTTMALISLANGLAHARKNGYALGAFNVLDSHFLRALFAAAKQERSPFIINIAEVHFKYLSLESLVEAVKFEAAHHDIPVVLNLDHGLHFEAVVRALRLGFSSVMFDGSTLEYEENVRQTREVVKMCHAVGVSVEAELGAVGGDEGGALYGEADSNKFTDPAIARDFVDRTGIDALAVAIGNAHGKYKGEPKLDFARLAAIHQQTGLPLVLHGGSGISDTDFRRAISLGIHKINFYTGMSQAALAAVEQKMTHRHAIYDEFAELFLGIEEAITDVVAQQMRIFGSSEQI

SEQ ID NO: 13013 - protein, 343 aa, GIBBERELLA ZEAE PH-1
MVKILPPTASIDWDQISIATNLGLGHVESTYHMSTGRWSDPVFVNDPYLRVHGLAPGLQYASVELAVTSNSSYVPPHTSRAMLYIRPFAFGSSEMIGLVPPSEYKFCVYVKPVPAYHGLSAQDALILTGFDRAAPHGLGHAKVGGNYAPVIKWSEQAKADGFGMTLHLDSKTRTEIDEFSTSGFLGIKVSDEGAVKVVAPSSPCIIDSTTSDCCLQLARHYGWNVEKRPIKYTELPEFSEVVAVGTAASVVSIRSITLEDSRETVRYLDATTNQGRYARKLSTSLDDIMHCRVEDVFGWCHQVGEAPVEDVPTRKMGSSNKKPAFVDIMTLSCAGQGARFSCH

SEQ ID NO: 13014 - protein, 176 aa, Triticum aestivum
  unsure (1)..(176): unsure at all Xaa locations
MAPTVMASSATSVAPFQGLKSTAGLPVSRRSNGASLGSVSNGGRIRCMQVWPIRGHQEFETLSYLPPLKHGGLLKQVXDYLDPSKWVPCLRFSKLGSSSRXAQPSPGYYDGRYWAMWXLPISGSPTPPRRLEGGQEGYPYPISHHFTNRKSCVTYPTGARSRLNITTAFKSCICPT

SEQ ID NO: 13015 - protein, 424 aa, Streptomyces avermitilis MA-4680
MTEHLEDILATVRPLEPIELQLLDAQGCVLVEDVTVPVSLPPFDNSSMDGYAVRVADVAGASEGFPAVLTVVGDVAAGQADLLHVGPGQAARIMTGAPLPPGAEAVVPVEWTDGGLGEGPVSGMRAHSAAPEGASGQVSVHRPAEARAHVRALGSDVRAGDRALAAGTVLGPPQIALLAAIGRGTVRVRPRPRVVVLSTGSELVQPDEKLGSGQIYDSNSFALTAAARDAGAIAYRVGAVADDAETLRSTIEDQLVRADLMVTTGGVSVGAYDVVKEALSTVGDEDEAGSGVEFRTLAMQPGKPQGFGSVGPDHTPLLALPGNPVSSYVSFELFVRPAIRTLMGLEDVHRPTTRAVLRTDKALTSPAGRRQFLRGTYADGEVTPVGGAGSHLIAALAQADALIVVPEDDTSVEPGTEVEVVLLG

SEQ ID NO: 13016 - protein, 197 aa, Pseudomonas aeruginosa UCBPP-PA14
MMGLGIVLLLRIRPTGGADPRGGFASVERVFAVLMIFTACSMAFAHGANDVANAIGPVAAVVAVVQAGGDLDLVSRSPVPSWVLLLGAVGIVIGLATYGYRVIATIGREITELTPSRGFAAELATASTVVGASAIGLPVSTTHTLVGAVLGIGMARGIGALNLRVIGSIFLSWVVTLPAGAVLAILFFLVLRALFGA

SEQ ID NO: 13017 - protein, 131 aa, Triticum aestivum
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFM

SEQ ID NO: 13018 - protein, 825 aa, Triticum monococcum
MAFSPRSPWSRSKKPDIYSTVVVHDDEDNARGGGAARAEDDDDDDPSALPPLLQRLPKDFGGASFDDDDDPYSSDLDDASLSATVVIKRGAPASTSSSSRSPFLDLRRSSPRAAEADPFSTFVVHGTARSGGASSPRESVSGTFIRHSGGPPSPRESVSGTFIRHTRGSSSPHESFSGTFIHHTSSASSPRDSASGAGAGFGSSFITPSSGQAEEDRQPSLLMQQQQSRRKASMSSLPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPPAIEMLKHKFIEKCNTGASKMLAKIKEAKIIRETAVQNQLPDSDDAMDATVRINEDYGETVPTNSQSTHETKNDGSGGDFGTMIVHPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 13019 - protein, 290 aa, Oryza sativa (japonica cultivar-group)
MGQPRAQLLPSMSMAALYLILATSPVISDMTDSLDMLWGNTQVLYDSTGHQIVSLSLDRWTTSAFRSKTKYLFARIDMDIKLVAKDSAGTVTTLYMITEGLWDIHDEIDLEFLGNTTGEPYTLHTNIYARGTGGREKQYRLWFDPTEDFHTYTIIWNPQMILILVDGTPIRQMKNQLRNDIPFPLYQPMRLYASIWDADDWATQGGRIKTDWSQAPFTAFFRNYQANACIPYKTAWICSQGSNDSSWFTQDLDEEGKQKLKDVDDNYKIYDYCTDSRRYPNGYPPECGSQ

SEQ ID NO: 13020 - protein, 169 aa, Triticum aestivum
  unsure (1)..(169): unsure at all Xaa locations
ITMDPTKFRPSSSHDTTVTTTNAGAPVWNDNEALTVGPRGPILLEDYHLIEKVAHFXARERIPERVVHARGAPAXGFFQCTHDVXXLTCADXLRAPRXGPLSCLLXVIHXRVPRNISRPRGSRXFXXRQGNWTAGIPVSPRRIPVSKPTRSTDTRCIDSRNFSPHTFHQ

SEQ ID NO: 13021 - protein, 173 aa, Methanopyrus kandleri AV19
MPVEKHVERAPKRLAIAVITVSTSKFEEAARGEEPEDTSGDILESRFEQAGHETRYRVLIPDQREMVAGAVKWTANRVDAVVTTGGTGLTPTDVTIEAVGEIAEKQVPGFGELFRRKSEEDVGAHSILSRAEMFVVDGTPVACLPGSPNAVKLGAELLIEVLPHVVVHSRGDV

SEQ ID NO: 13022 - protein, 91 aa, Synechococcus sp. PCC 7942
MTTLPLPETPLYNHSLPAIETWLRDLGSIQDLEALNCWSLRHTDWSAEIELGTDQIVVCYRSAGEAGQDLTRAYKYSLSRADLEAVILGGP

SEQ ID NO: 13023 - protein, 478 aa, ASPERGILLUS NIDULANS FGSC A4
MSATEVTSENVAQILQNDTRVKLAGVDADGMLRGKLVSKKKFLSVVDEGFGFCSVIFGWDMHDRTYFRELGISNKENGYRDLLAKPDLSSFRRIPWENNVPFFLVSFYDPDTKEPLFACPRSLLRMALRKPEAQGYRAMAGAEYEFYQFATPNRNASSTASFLKENPVEALPSITDGMFGYSLTRPIHNQDYYYGIFDACEQFNCEIEGWHTESGPGVYEAALQFGEAKGMADKAGLFKYVVKSIGTKHGITPTFMAKPREGLPGNSGHMHISLVNSDDTNAFHRSTPDPSPPYPDVAYLSDLGRCFLAGILTGLPDIMPMFAPTVNSYKRLVENFWAPVTVSWGLEHRAASIRLITPPTASPKATRLEVRVPGADANPHFVLAAIVALGWWGVEKKLEIPVPPLSKGEDMGGESDKGVRLAKNLGAAIATFTRKDSVAREVFGDAFVDHFGGTREHELRLWEEAVTDWEVRRYIETV

SEQ ID NO: 13024 - protein, 338 aa, Yersinia pestis CO92
MAIRIAINGFGRIGRSVLRALYESGRRAEISVVAINELASAEGMAHLLKYDSSHGRFAWDVRQECDSLYVGDDIIRLIHQSEIEQLPWSELGIDVVLDCSGVYGSREDGEAHVASGAKKVLFAHPGGHDLDATVVYGVNHQDLRAEHRIVSNASCTTNCIIPIIQLLDIAYGIESGTVTTIHSSMNDQPVIDAYHQDLRRTRAASQSIIPVDTKLAAGITRIFPKFCDRFEAISVRVPTINVTAIDLSVSVTHPVGVAEVNQLLQKAARGAFRGIVDYTELPLVSMDFNHDPHSAIVDGTQTRVSGQHLIKTLVWCDNEWGFANRMLDTTLAMAKSGF

SEQ ID NO: 13025 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 13026 - protein, 148 aa, Zea mays
  unsure (1)..(148): unsure at all Xaa locations
SVSRVSGHVAXXKSSDFFQEYGMGNGFQKKXSNASKAQVEETDEARKKFSNAKAISSSQXXGTXNREEKEAQLSLQKFAGSSSISSADXXGRNDADNSNLDLSAADLINRISFQASQDLSSLKDIAGETGKKLTSLASNFISDLDRIL

SEQ ID NO: 13027 - protein, 412 aa, Shigella flexneri 2a str. 2457T
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKCYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENHDRIRQAIRGIKAMFRADGLLPVSSKHIHENAE

SEQ ID NO: 13028 - protein, 371 aa, Agrobacterium tumefaciens str. C58
MIGARPAAYQTNKGGQKMPALANLNIVPFISVENMMDLAVSTGIENFLVQLAGYIEEDFRRWESFDKIPRIASHSRDGVIELMPTSDGTLYGFKYVNGHPKNTKSGRQTVTAFGVLSDVDSGYPLLLSEMTILTALRTAATSAIAAKYLARKDSRTMALIGNGAQSEFQALAFKALIGVDRIRLYDIDPEATARCSRNLQRFGFQIEACTSAEQAVEGADIITTATADKHNATILSDNMIGPGVHINGVGGDCPGKTEMHRDILLRSDIFVEFPPQTRIEGEIQQLAPDHPVTELWRVMTGQDVGRKSDKQITLFDSVGFAIEDFSALRYVRDRVEGSSHSSPLDLLADPDEPRDLFGMLLRRQAFRRLGG

SEQ ID NO: 13029 - protein, 479 aa, Glycine max
MNSDQFQKNSMFVETPEDGGKNFDDDGRVRRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 13030 - protein, 631 aa, Emericella nidulans
MGLLSFRQPSWRISRSQFYPIWALSQLLLNPIAVLAQSAADYYVESLPGAPEGPLLKMHAGHIEVDPEHNGHLFFWHYQNRHIANRQRTIIWLNGGPGCSSMDGALMEIGPYRLKDNETLEYNEGSWDEFANLLFVDQPVGTGFSFANTNSYLHELDEMAAQFITFLEKWFAVFPEYERDDIYIAGESYAGQYIPYIAKAIQDRNKDIHEKQSSSARWNLRGLLIGNGWISPAEQYPAYLSFAYEEGLVEEGSKLGKELETLLSICKSKMETGPKISITDCEAVLNKLLDKTVDSNNQCINMYDIRLRDGSCGTTWPPDLVDVKPYLHTYEVIQALNISPEKESGWDECDGNVGAAFRPQKSEPSVKLLPGLLESGIEILLFSGDKDLICNHVGTEQLISNMKWAGGTGFETSPGVWAPRHDWTFEDEPAGYYQYARNLTYVLLYNASHMAPFDLPRRTRDMVDRFMHVDIASIGGAPADSRIDGEPLPQTSVGGQPNSTVHQEEEQQKIKETEWNAYAKSGEAVLVVVIIGVLVWGFLIWRSRRRHNGYSGIAIKSPSRTSIMGRFHNNHSNGADVEAGDFDEAELDDLHSPGLDRENYAVGEDSDDEAHRQDLPRAQESSSKSENNLVT

SEQ ID NO: 13031 - protein, 454 aa, Hypnea spinella
GYWDPEYVIKETDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYAMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 13032 - protein, 306 aa, Saccharomyces cerevisiae
MKVNMEYTKEKKVGEGTYAVVYLGCQHSTGRKIAIKEIKTSEFKDGLDMSAIREVKYLQEMQHPNVIELIDIFMAYDNLNLVLEFLPTDLEVVIKDKSILFTPADIKAWMLMTLRGVYHCHRNFILHRDLKPNNLLFSPDGQIKVADFGLARAIPAPHEILTSNVVTRWYRAPELLFGAKHYTSAIDIWSVGVIFAELMLRIPYLPGQNDVDQMEVTFRALGTPTDRDWPEVSSFMTYNKLQIYPPPSRDELRKRFIAASEYALDFMCGMLTMNPQKRWTAVQCLESDYFKELPPPSDPSSIKIRN

SEQ ID NO: 13033 - protein, 151 aa, Methanothermobacter thermautotrophicus str. Delta H
MNLKTHAFNDRGRIPSRYTCDGENISPPLSWDGVPGEAKSLALICDDPDAPSKVWTHWVIFNIPPDSTGLEENVPDAGRLPDGSVQGYNDSGTLGYRGPCPPSGVHRYFFRLYALDTVLDLEPGASKEDVLEAMEGHVLGEAKLIGLYRRG

SEQ ID NO: 13034 - protein, 341 aa, Oryza sativa
  unsure (1)..(341): unsure at all Xaa locations
GAAKAVPFISPQAKSTGGASSNGGKRRHTRAGTPRRGGWHGTCAVMALEXRILADIRAQAASPTCPTRPSARHNFRVLFVCGCRDLGEALRRIREGAAIIRTKGEAPLTWPTQGRKGCCSICWLFLCFCLDNASNSHRPTVPATAATAANNLLQPSVESSRRERSKREGGKLRHGWVPPLPPPSPEPPATPPSLLPPLAELPPPPLPSVGSGRQEGEGEEGSRTAATLLSGNHRHPSSLPDLGGEGSQIWERKGGPCCLLRTPSATSLYGHATAAAPPLCRRERGRVRGRAPRLLRRQCRLWLALSSSLVVVGAAVVSTHVDIDFDSYFTGRITWTATGSE

SEQ ID NO: 13035 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 13036 - protein, 413 aa, Rhodospirillum rubrum
MDHDFYRIKRLPPYVFAEVNAMKARARAAGDDIIDLGMGNPDQPTPQHIVDKLCEAATNPRAHGYSMSRGIPGLRKALAGYYARRFNVELDPETEAIVTLGSKEGLANLAQAITSPGDIVLAPNPSYPIHAFGFIIAGGAVRHIPAKPGPEFLEAMERGVRHSVPKPVAVLINFPSNPTAYVADLDFYGQVVDFCRHHGIWILSDIAYSEIYFDHKPPPSVLQIPGAKEVAIEFTSLSKTYNMPGWRIGFAAGNRHLIGALTRIKSYLDYGAFTPVQVAATAALNGPQDCVEDIRTLYRERRDVLIDGLAQAGWDIPSPPASMFAWAPLPKGFEHLGSLEFSKLLMREAKVAVSPGVGFGEYGDSHVRIALVENKHRIRQAVRNIKAFLGGGQGGETGLGAKGEDKQKADEAV

SEQ ID NO: 13037 - protein, 93 aa, Glycine max
RTSSQVVTTVNRAGAGLVVQLTGLKSMVGFPTRKTNIAFTSIVGTGGGVHCLQGWPPIGKKKLGTFSYLPDLDDAQLAKEVDSLLRKGWIPCL

SEQ ID NO: 13038 - protein, 335 aa, Brucella melitensis biovar Abortus
MAVRVAINGFGRIAVTILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAISEAANGRLKGILGYTDEKLVSHDFNHDSHSSVFHTDQTKVMEGTMVRILSWYDNEWGFSSRMRDTAVALGKLI

SEQ ID NO: 13039 - protein, 729 aa, Zea mays
MAMAAIASPSSRTLIPPRHHGAAPSPSTSGDSSLRLLRAHPRHGRRGRAVSVSTPAARSRPFVFSPRAVSDSKSSQTCLDHDASKCESLPPHNPQPASSDNSQSRLRRATPQFSSCKPWTWLWRLKPPLRHGMPPPPSSQFQSVTKPLQMIQHTSILKLMIVFLESFWEVVLGLECPPCSSETPRAGRGTPLRSVSHCPPITPPALSRPLPRARSDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEKRATAFGLMKIDDEGRIVEFAEKPKGEKLRAMMVDTTILGLDHERAKEMPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 13040 - protein, 500 aa, Bacteroides thetaiotaomicron VPI-5482
MNQELLMNPNCLVAALEKPAAEFTKADIISFIQKNNIRMVNFMYPAADGRLKTLNFVINNAAYLDAILTCGERVDGSSLFPFIEAGSSDLYVVPRFRTAFVDPFAEIPTLSMLCSFFNKDGEPLESSPEHTLHKACKAFTDVTGMEFQAMGELEYYVISPDTGMFQATDQRGYHESAPYAKFNDFRTQCMSYIAQTGGQIKYGHSEVGNFTLDGMIYEQNEIEFLPVHAEDAADQLMIAKWVIRNLGYRYGYNVTFAPKITAGKAGSGLHVHMRIVKDGQNQMLKDGVLSETARKAIAGMMELAPSITAFGNTNPTSYFRLVPHQEAPTNVCWGDRNRSVLVRVPLGWAAKTDMCTLANPLESESHFDTSQKQTVEMRSPDGSADLYQLLAGLAVACRHGFEIEQALDIAKRTYVNVNIHQKENEDKLKALAQLPDSCAASAECLQKQRAVFEQYNVFSPAMIDGIIRKLRSYEDKTLRADMEGKPEEMLELVHKYFHCG

SEQ ID NO: 13041 - protein, 423 aa, Batrachospermum helminthosum
  unsure (1)..(423): unsure at all Xaa locations
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGXQAGATANRVALESMVLARNEGCDFVNEGPQILRDAAKTCGPLQTALDLWKDISFNYTSTDT

SEQ ID NO: 13042 - protein, 731 aa, Pyrobaculum aerophilum str. IM2
MSDWIELRVQESKARDANRPVVRIDPEVMERAGIVVGDVVEIVGRRRTAAKVWNGLPEDRGKGVIRMNSILRKNADVSLNETVKVRRVEPKPAAFVKLAPVSMTIAVDANFLQYIKQRLREYVLVEGDMLQIHVLSQPLTFQVVQTKPSNTVLIITEDTQIQIFEKPVSGVKIPHVTWEDIGDLEDAKQKIRELVELPLRHPELFKHLGIEPPKGILLIGPPGTGKTLLAKAVANEANAYFVAINGPEIMSKYYGESEARLREIFEEAKKNAPAIIFIDEIDAIAPKREEVTGEVEKRVVAQLLTLMDGLQERGQVIVIGATNRPDAVDPALRRPGRFDREIWINPPDFKGRYEILLIHTRNMPLAPDVDLRKLAEMTHGFSGADLAALAREAAMSALRRAIQSGLIDLNQPSIPPEVFEKIKVTMTDFTSALREIVPSALREIHIEVPRVRWEDVGGLENVKQELREAVEWPLKYPDKFKKFGLRPPKGILLFGPPGTGKTLLAKAVATESGANFIAVRGPEIFSKWVGESEKMVREIFRKARMAAPAVVFIDEIDALATARGLGGDSLVTERVVAQLLAEMDGIKALENVVVIAATNRPDLVDPALLRPGRFDRIIYVPPPDFKARLDILLIHTRSTPLAKDVDLEELARRTEGYSGADLELLVREATFLALREDINAKEVSMRHFEEAMKKVRPSITPDMLKFYESWLEKARQLTVSAKAKATPPLYL

SEQ ID NO: 13043 - protein, 188 aa, Stigmatella aurantiaca
MADLSVRRGTGSTPQRTREWDPFQQMQELMNWDPFELANHPWFANRQGPPAFVPAFEVRETKEAYIFKADLPGVDEKDIEVTLTGDRVSVSGKREREKREESERFYAYERTFGSFSRAFTLPEGVDGDNVRADLKNGVLTLTLPKRPEVQPKRIQVASSGTEQKEHIKAYPAPAEPGLAAPLGWPGFS

SEQ ID NO: 13044 - protein, 58 aa, Avena vaviloviana
KGKLPKEARLKLLHWWELHSKWPYPSETEKIALAETTGLDQKQINNWFINQRKRHWKP

SEQ ID NO: 13045 - protein, 141 aa, Salmonella enterica
KPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13046 - protein, 176 aa, Helicobacter pylori J99
MQTIHIGVLSASDRASKGVYEDLSGKAIQEVLSEYLLNPLEFHYEIVADERDLIEKSLIKMCDEYQCDLVVTTGGTGPALRDITPEATKKVCQKMLPGFGELMRMTSLKYVPTAILSRQSAGIRNKSLIINLPGKPKSIRECLEAVFPAIPYCVDLILGNYMQVNEKNIQAFRPKQ

SEQ ID NO: 13047 - protein, 493 aa, Galdieria partita
  unsure (1)..(493): unsure at all Xaa locations
MSQSIEEKSVQERTRIKNSRYESGVIPYAKMGYWNPDYQVKDTDVLALFRVTPQPGVDPIEAAAAVAGESSTATWTVVWTDLLTAADLYRAKAYKVDQVPNNPEQYFAYIAYELDLFEEGSIANLTASIIGNVFGFKAVKALRLEDMRLPLAYLKTFQGPATGVILERERLDKFGRPLLGCTTKPKLGLSGKNYGRVVYEALKGGLDFVXDDENINSQPFMRWRERYLFTMEAVNKASAATGEVKGHYLNVTAATMEEMYARANFAKELGSVIIMIDLVIGYTAIQTMAKWARDNDMILHLHRAGNSTYSRQKNHGMNFRVICKWMRMAGVDHIHAGTVVGKLEGDPIITRGFYKTLLLPKLERNLQEGLFFDMEWASLRKVMPVASGGIHAGQMHQLIHYLGEDVVLQFGGGTIGHPDGIQAGATANRVALEAMILARNENRDYLTEGPEILREAAKTCGALRTALDLWKDITFNYTSTDTSDFVETPTANI

SEQ ID NO: 13048 - protein, 391 aa, Xanthobacter polyaromaticivorans
MSELLLRVGGDEGSAADCAVLERKSPADGVVVSRVAAAKRADVEAAIATAHAAYIEWSKTGPSHRRMLLLKAADELEKRADSLVEAMKDEVGSAELWARFNVMAAAELFREAASMATQLQGETIPTDKPGTLSMTLRQPVGVILSIVPWNGPIVLAARAIAYPLVCGNTVIFRASEMSPRVHALVVEAVHAAGFPQDSLKLIVNLPEDAPELIEAMIADPRVRRVNFTGSTRVGRIIGELCGRHLKKSVLELGDKSPLVVLCDADVEAAVNAAIFGAFLYQGQICMSTERLIVHETIADEFVERLAARVMTLKTGDPRAQAAWALGPVVSLGAADRLNRLRLNRLLDDAVSKGAKILAGGRAQQTFMDATVLDHVTRDMAIYREEVFGPIL

SEQ ID NO: 13049 - protein, 311 aa, Staphylococcus lugdunensis
GFGRIGRLAFRRIQDVEGIEVVAVNDLTDDDMLAHLLKYDTMQGRFTSEVEVVDGGFRVNGKEVKSFEEPDASKLPWGDLGVDVVLECTGFYTDKEKAEAHIHAGAKKVLISAPAKGDVKTIVYNTNHSDLDGSETVVSGASCTTNSLAPVAKVISDEFGLVEGLMTTIHAYTGDQMTQDGPHRKGDKRRARAAAQNIVPNSTGAAKAIGKVIPEIDGKLDGGAQRVPVATGSLTELTVVLEKQDVTVEQVNEAMKKASNESFGYNEDEIVSSDVVGMTYGSLFDATQTRVMSVGGRQLVKVAAWYDNEMS

SEQ ID NO: 13050 - protein, 309 aa, Eremothecium gossypii
MSPSTDTPVSKLGSFAAAGAAACVAVTFTNPIETVKTRLQLQGELVAGVSRLYSGPAQAVSLIYRTEGLRGLQQGLACAYAYQILLNGSRLGLYDPLRAALGGCVLSDRRTYGTAALAVNATAGAAAGMIGAALGSPLQLVKTRMQALAPRRVPPLPGRMGRRLVALFKDRGVRGLYQGVDAALLRTGVGSAVQLAVYSHAKEALSRHVPDGMALYTLASALSSVAVCIAMNPFDVAMTRMYHHRGGLYRGPLDCLCKTVRQEGFSALYKGHLAQLLRIAPHTILCLTLMEQALRVVRLVENRLPQIRP

SEQ ID NO: 13051 - protein, 397 aa, Pisum sativum
MALSRLSSSSSSSNGSNLFNPFSAAFTLNRPISSDTTATLTIETSLPFTAHNCDPPSRSVTTSPSELLSFFRTMALMRRMEIAADSLYKANLIRGFCHLYDGQEAVAVGMEAGTTKKDCIITAYRDHCTFLGRGGTLLRVYAELMGRRDGCSKGKGGSMHFYKKDSGFYGGHGIVGAQVPLGCGLAFGQKYLKDESVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQERDPIERVRKLLLSHDIATEKELKDTEKEVRKEVDEAIAKAKDSPMPDPSDLFSNVYVKGYGVEAFGVDRKEVRVTLP

SEQ ID NO: 13052 - protein, 523 aa, Neurospora crassa
MGLSLKKPEGVPGKSWPAIVIGLFVAFGGVLFGYDTGTIGGILAMPYWQDLFSTGYRNPEHHLDVTASQSATIVSILSAGTFFGALGAAPLADWAGRRLGLILSSFVFIFGVILQTAAVSIPLFLAGRFFAGLGVGLISATIPLYQSETAPKWIRGVIVGSYQLAITIGLLLASIVNNATHNMQNTGCYRIPIAVQFAWAIILIVGMIILPETPRFHIKRDNLPAATRSLAILRRLEQNHPAIIEELSEIQANHEFEKSLGKATYLDCLKGNLLKRLLTGCFLQSLQQLTGINFIFYYGTQFFKNSGFSDSFLISLITNLVNVVSTLPGLYAIDKWGRRPVLLWGAVGMCVCQFIVAILGTTTTSQDASGMIIVHNLAAQKAAIAFICFYIFFFAASWGPVAWVVTGEIFPLKVRAKSLSITTASNWLLNWAIAYSTPYLVNYGPGNANLQSKIFFVWGGCCFICIAFVYFMIYETKGLTLEQVDELYEEVSDARKSIGWVPTITFREIREEKKNICVAAALK

SEQ ID NO: 13053 - protein, 1478 aa, Saccharomyces cerevisiae
MPFLRKIAGTAHTHSRSDSNSSVKFGHQPTSSVASTKSSSKSPRATSRKSIYDDIRSQIPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESPLSPTKSGPSKTDEKIFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRSTPKPRVITMTEVSNTNPTEELNYWNIKEVLSHEENAPKMVFKTSPKLELNLPDKGSKLNIPTPITENESKSSFQVLRKDEGTEIDFNHRREAPYTKPEVAPKRESPKPPANTSPQRTLSTSKQNKPIRLVRASTKISRSKRSKPLPPQLLSSPIEASSSSPDSLTSSYTPASTHVLIPQPYKGANDVMRRLKTDQDSTSNSPSLKMKQKVNRSNSNVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 13054 - protein, 103 aa, Oryza sativa
  unsure (1)..(103): unsure at all Xaa locations
PAGNKQLVFPVPAFNVINGGSHAGNSLQXRKFMIFYWAALFKEAXMKMGVEGVXNNLKSVIKKKYGQXDATNVGDEGGFSPNIQENKEXLXLEEAIEKAGYTG

SEQ ID NO: 13055 - protein, 229 aa, Oryza sativa
LTTVAAKLPVLPLRACGTGTTAPVPPPTASLRRELALSPNLPARGGVAGQPNAATREAPAAAVSSARRVVVVSPSLAGYLDEQFCQVEDLQDEASPNFVEEVVTLFFKDSGRLMSNIEQALEKYPRDFNRWDTYMQQLKGSCSSIGASRMKNECMSFRDSCGQGNVEGCMRSFQKVKREHAVLRQKLESYFQLLRQAGPAGAATRPVMAHIGHASGSVLPTLFLFSEAC

SEQ ID NO: 13056 - protein, 466 aa, Escherichia coli K12
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 13057 - protein, 265 aa, Triticum aestivum
  unsure (1)..(265): unsure at all Xaa locations
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGNLQGNFLASFALGWIVTTGAGIASYPLDTIRRRMMMTSXGEGVKYKNTMDA

SEQ ID NO: 13058 - protein, 362 aa, Zygosaccharomyces bailii
MSKNIVVLPGDHVGQEIAQEAIKVLEAISEVSPKAKFNFQHHLIGGSAIDATGSPLPDEALAAAKKADAVLLGAVGGPKWGTGAVRPEQGLLKIRKELQLYANLRPCNFASESLLELSPLKPQHARGTDFIVVRELVGGIYFGQRKEDDGDGVAWDSERYTKPEVQRITRMAAFLALQHNPPLPIWSLDKANVLASSRLWRKTVEETIKNEFPQLTVKHQLIDSAAMILIKNPTQLNGIIITSNMFEDIISDEASVIPGSLGLLPSASLASLPDTNEAFGLYEPCHGSAPDLPKGKVNPVAMILSAAMMLKLSLNMAKEGEALETAVKQVLDSGVRTGDLGGSNSTSEVGDAIAKAVKQILA

SEQ ID NO: 13059 - protein, 334 aa, Phaeodactylum tricornutum
MPVSLGINGFGRIGRLVMRAALEHPDATVVAVNDPFLTPEYAAYQFKYDSVHGTYSEDVSFEEGYLVVGDKKIRFFSERNPEEIGWGSVGAEIVCESTGVFTTIDKAQAHINGGAEKVVISAPSADAPMYVMGVNHTTYSGATVFSNASCTTNCLAPLAKVLHEEFGIVEGLMTTIHAGTATQLVVDGPAKRGKDWRAGRSSLANLIPASTGAAKAVGKVIPELNGKLTGMAVRVPTADVSMVDLTIRTEKAVSAAELKAALKKASEGPMKGILGYTEDAVVSQDFVHDPRSSIVDASAGIALNDNFHKVIAWYDNEWGYSNRLVDLAIYTSGK

SEQ ID NO: 13060 - protein, 474 aa, Rhodococcus ruber
MTAGHFTELYINGSWVASTSKTVIEVLNPATEEVIGTVPDGTAADVDAAVAAARAAFDGWASTPVDKRAQYLRAIAAGIADRSDELARTISAEMGAPLSFAQAMQVPLPINSFSHAAAVAESFPFERTEGSSVIVREPIGVVGAITPWNYPLHQIAAKVAYALAAGNTIVVKPSEVAPLNAWMLAEIIDAAGVPAGVFNLVSGTGPVVGEALASHHEVDMISFTGSTNAGKRVSELAAQTVKRVALELGGKSANIVLDDADIDELMPNAVQWAMINSGQTCSALTRLLVPRAILTEAETAAKTIAEAYTVGAPDDPDTTLGPLVSATQLKRVRGYIDRGVQEGATLITGGSEPVEGLAVGYYVKPTIFSEVTPDMTIHREEIFGPVLSIAPYDTEEDAVRIANDSEYGLRGGVWSRDVDRARAVAARMRTGQVMINGGEFNPNAPFGGYKQSGTGREFGTHGLEEFLEIKSLQF

SEQ ID NO: 13061 - protein, 250 aa, Brassica oleracea var. botrytis
MGRGRVELKRIENKINRQVTFAKRRNGLLKKAYELSVLCDAEVALIIFSNRGKLYEFCSSSNMIKTLERYQKCSYGSIEVNNKPAKELENSYREYLKLKGRYEGLQRQQRNLLGEDLGPLNSKELEQIERQLDGSLKQVRSIKTQYMLDQLSDLQTKEQMLLETNRALAMKLDDMIGVRSHHMGGGGGGWEGNEHNVSYAHHQAQSQGLFQPLECNPTLQMGYDNPVCSEQITATTQAQAQPGYIPDWML

SEQ ID NO: 13062 - protein, 322 aa, Hordeum vulgare subsp. vulgare
MDTSTRAAKIPSLPQQTEINWDNLDMTKLYVVGAGMFSCVTVALYPVSVIKTRMQVASGEAMRRNALATFKNILKVDGVPGLYRGFGTVITGAIPARIIFLTALEKTKATSLKLVEPLQLSESMEAALANGLGGLTASLCSQAVFVPIDVVSQKLMVQGYSGHVRYKGGIDVVQKIMKADGPRGLYRGFGLSVMTYAPSSAVWWASYGFSQRVIWSALGRLDDKEDTPSQLKIVGVQATGGMVAGAVTSCVSTPLDTIKTRLQVNINKPKASEVVRRLIAEDGWKGFYRGLGPRFFSSSAWGTSMIVCYEYLKRVCAKVEEA

SEQ ID NO: 13063 - protein, 267 aa, Oryza sativa (japonica cultivar-group)
MGEIHALRNMDDDEVFAYAKRIAAPYNLVMQTKQLGRLPVVQFAAGGVATPADAALMMQLGCDGVFVASGIFKSGDPARRARAIVQSVTHCRSSRPSTLPPRRPCWHTFAVELCPNRYMVMEAFIDTAGKDQSDPLILTQLNSTKAIRDSIQINFGECGLAACLGSLQGIYELYSSIVKYVNPITKLCVIRVSREDHQKVWAAITMVRSIGKIPVSFNLRDVSGSIRACKKAALECEEAKFEYYKLAAGDRITPKFVETMESCFNKD

SEQ ID NO: 13064 - protein, 294 aa, Arabidopsis halleri
LPVIDFSDQTLKPGSSKWDEVKADVRKALEDYGCFEASFDKVSVELKKSVFEAMEELFELPIQTKQRNVSSKPFHGYLCHNLYQSLGIDDANVLEKVDDFTQQLWPDQGNKTISETIHRFSEQLVELDVMVRRMIMESFGIEKYIDEHVNSSNYLMRFMKYTSPPDDDDEETKLGLRSHTDKNIITILHQYQVGGLEVKTKDDKWIKVQPSQDSVLIMLGDSLCALLNGRLPSPYHRVIMMSKKTRYSTGLFSIPKTGVIIDSPEELVDEEHPRIFKPFEYKDFIHFFHTEAGR

SEQ ID NO: 13065 - protein, 270 aa, Zea mays
  unsure (1)..(270): unsure at all Xaa locations
MVEQGKPRSIPTKAKKSPFVEVEVDEIGQASGVVFARESPLAPKSDQGCSVSHSHGDDETHESDGCVQSQGLDEHGXVDFGHSLQLVLFSRQWSLAESLVDLADQQPMLDYGLSIALDAIWFLRTKQDLEGLNSLISKIVASGAXDFARAILRTSLLASCVAACQSKAITVGTSKEIVAERLHDRLRDCPGAEHLKXEAGAKVQKFMGWALQCIHMHHWSEDTHMYRWNYNTLQEVQLHVSAFRTFLDIAGDNLSGRFYRGFVRLLPLHF

SEQ ID NO: 13066 - protein, 327 aa, Chlamydophila pneumoniae CWL029
MSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATEKLAEGIRIFAGDTQILETAITEFIKQIAAEGA

SEQ ID NO: 13067 - protein, 206 aa, Chloroflexus aurantiacus
SHLPASTGVITGVAHAIKLKGEPRVAMCFFGDGSASQGLAHEAMNWASVFKLPMVIICENNQYAYSTPLSRQMAITDIAQRAAGYAMPGVIVDGNDFAAVYRATKEAVERARAGGGPTFIECKTMRMRGHAIHDNMAYVPKELLAEWEARDPIARIEEVLRSRGLLDDAKLAALLARIEAELDEAQAFAEASPYPDPATLTDGVYA

SEQ ID NO: 13068 - protein, 442 aa, Cytophaga hutchinsonii
MLKKFAPLIVLLVVCVLALLNPGLPKETITEGLDSGDIAWLLTSAAFVLLMTPGLAFFYGGMVNPKNVISTMLQSFVAMGIISILWVVIGFSMAFGDSFGGFVGDPRTYFMFNGVLEHAPFGTIPFVLFAFFQLKFAVITPALFTGSFSERIRFTSYIIFMILFCLFIYTPIAHWTWHADGFLYKMGVLDFAGGTVVHMSAGCAALAGAIYLGKRKDKNHPTAINVPYILLGTGLLWFGWFGFNAGSAAAANPLAASAFAATNVAAGAAGIAWLFVEAARGKKPSAMGFSIGAVVGLVAITPAAGFVTVSQALFIGSVASMISAAAIVLLAKTSIADDTLDVFPCHGVGGMTGMIMTGLFASTAVNAAVAEQGLFIDGSTTLILKHLLALVIVVAYSLIGSYILLFITDKISPLRVTAEEEELGLDTTQHDEKFVIADLVKK

SEQ ID NO: 13069 - protein, 332 aa, Bacillus anthracis str. Ames
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 13070 - protein, 362 aa, Arxula adeninivorans
MSKNIIILSGDHVGPEVTAEAIKVLEAITQARPNVKFNFDHKLIGGAAIDATGSPLPDETLEASKKADAVLLGAVGGPKWGTGAVRPEQGLLKIRKELNLYANLRPCNFMSEKLLDLSPLRSEIVKGTNFTVVRELVGGIYFGTRKEDEGNGEAWDTEKYTVEEVKRITRMAAFLALQSNPPLPVWSLDKANVLASSRLWRKTVTETIEKEFPQLTLNHQLIDSAAMILIQNPSKMNGVIVTSNMFGDIISDEASVIPGSLGLLPSASLSSLPDKNTAFGLYEPCHGSAPDLPPNKVNPIATILSAAMMLRLSLNLKEEADAVEKAVSKVIDNGIVTADLKGASSTTEVGDAVAAEVQKLLK

SEQ ID NO: 13071 - protein, 418 aa, Pseudomonas aeruginosa PAO1
MGYQKIQVPATGDKITVNADMSLSVPKNPIIPFIEGDGIGVDISPVMIKVVDAAVEKAYKGERKIAWMEVYAGEKATQVYDQDTWLPQETLDAVRDYVVSIKGPLTTPVGGGIRSLNVALRQQLDLYVCQRPVRWFEGVPSPVKKPGDVDMVIFRENSEDIYAGVEWKAGSPEAEKVIKFLTEEMGVKKIRFTENCGIGIKPVSQEGTKRLVRKALQYAVDNDRSSVTLVHKGNIMKFTEGAFKDWGYEVARDEFGAELLDGGPWMQFKNPKTGKNVVVKDVIADAMLQQILLRPAEYDVIATLNLNGDYLSDALAAEVGGIGIAPGANLSDSVAMFEATHGTAPKYAGQDKVNPGSLILSAEMMLRHMGWTEAADLIIKGTNGAIAAKTVTYDFERLMDGATLLSCSEFGDAMIAKM

SEQ ID NO: 13072 - protein, 625 aa, Azotobacter vinelandii
MCSPSAAAQASGAGSRKAKSMPSGVPARASMRPSWPPPITPIFILSELPFSGFARVRIVEHATGLLLAETLERFEEPRVPGAENAGGEQRGIDRAGPADGQGGDRHAGRHLHDGEQRVDPGEHRRLHRHAEHRQVSLGRAHARQVGGAAGAGDDHLDAAGRGLVGVLEEQIRRAVGGNHPDFVGDAQLVQHLHAVTEGAPVRLGPHDHAYQCAHLHASRWRPQAHQKTTSHAGRAWLGGVANLSGYERGSHYQAAEYNPKPDAEVQAHAPPVRVIMNIPCPRRDQTMAAIDQLMVLYSGGTIGMQAGPRGLVPAAGFDARLRERLIAEPQRRMPPWRYRELSPPIDSANMHQGHWLTLRDAIVAAVEKDGCNAVLLLHGTDTLAYSAAALSFLLLGLGVPVVLTGAMLPASVPGSDAWDNLFGAVDALAQGLVPGVHLYFGGRLLHGARASKLGSATFEAFAELPRRRHGSRTATLPAGLDYHTLRQPVNLAVLPLFPGLRATQLRALLDSGVQGLVLECYGSGTGPSDDAELLEALREARRRGTVLLGISQCPHGHVAFDTYAAGDALREAGLIGGDGMTREAALGKLFALLGAGLPAEEAEYWLAQDLCGECADSSPAGADRP

SEQ ID NO: 13073 - protein, 644 aa, Oryza sativa (japonica cultivar-group)
MATTAAAAAAALSAAATAKTGRKNHQRHHVLPARGRVGAAAVRCSAVSPVTPPSPAPPATPLRPWGPAEPRKGADILVEALERCGVSDVFAYPGGASMEIHQALTRSPVITNHLFRHEQGEAFAASGYARASGRVGVCVATSGPGATNLVSALADALLDSVPMVAITGQVPRRMIGTDAFQETPIVEVTRSITKHNYLVLDVEDIPRVIQEAFFLASSGRPGPVLVDIPKDIQQQMAVPVWDTSMNLPGYIARLPKPPATELLEQVLRLVGESRRPILYVGGGCSASGDELRWFVELTGIPVTTTLMGLGNFPSDDPLSLRMLGMHGTVYANYAVDKADLLLAFGVRFDDRVTGKIEAFASRAKIVHIDIDPAEIGKNKQPHVSICADVKLALQGLNALLQQSTTKTSSDFSAWHNELDQQKREFPLGYKTFGEEIPPQYAIQVLDELTKGEAIIATGVGQHQMWAAQYYTYKRPRQWLSSAGLGAMGFGLPAAAGASVANPGVTVVDIDGDGSFLMNIQELALIRIENLPVKVMVLNNQHLGMVVQWEDRFYKANRAHTYLGNPECESEIYPDFVTIAKGFNIPAVRVTKKSEVRAAIKKMLETPGPYLLDIIVPHQEHVLPMIPSGGAFKDMILDGDGRTVY

SEQ ID NO: 13074 - protein, 354 aa, Pseudomonas stutzeri
MALISMRQMLDHAAEFGYGVPAFNVNNLEQMRAIMEAADKTDSPVIVQASAGARKYAGAPFLRHLILAAIEEFPHIPVCMHQDHGTSPDVCQRSIQLGFSSVMMDGSLREDGKTPADYDYNVRVTQQTVAFAHACGVSVEGELGCLGSLETGMAGEEDGVGAEGVLDHSQLLTDPEEAADFVAKTKVDALAIAIGTSHGAYKFTNPPTGDTLSIQRIKEIHARIPDTHLVMHGSSSVPQEWLKIINEYGGEIGETYGVPVEEIVEGIKYGVRKVNIDTDLRLASTGAIREFLAKNPSEFDPRKYFAKTVAAMRDICIARYEAFGTAGNASKIKPISLEGMFQRYASGELDPKIN

SEQ ID NO: 13075 - protein, 336 aa, Burkholderia fungorum
MTIRVAINGYGRIGRNTLRAFYENGKKHDIEIVAINDLGDARTNAHLTQYDTAHGKFPGEVSVDGDYLVVNGDKIRVLANRNPAELPWGELNVDVVMECTGFFTTKEKASAHIKGGAKKVIISAPGGKDVDATIVYGVNHHVLKASDTVISNASCTTNCLAPLVKPLNDKIGLVNGLMTTIHAYTNDQVLTDVYHEDLRRARSATHSQIPTKTGAASAVGLVLPELNGKLDGYAIRVPTINVSIVDLSFIAARDTTVEEVNAIMKEASEGSLKGILGYNQAPLVSIDFNHNPASSTFDATLTKVSGRLVKVSSWYDNEWGFSNRMLDTAVALAHAK

SEQ ID NO: 13076 - protein, 885 aa, Pseudomonas fluorescens PfO-1
MRALLASTSRPFVPQPLEPDTAMSSRKFGLNLVVVLAIAALFTGFWALINRPVSAPNWPEQISGFSYSPFQQGQFPQKDQYPSDDEMRRDLEIMSKLTDNIRIYSVDGSLQDIPKLAEEFGLRVTLGIWISPDQERNEREITRAIELANTSRSVVRVVVGNEAIFRKEITAQELSVLLDRVRAAVKVPVTTSEQWHVWEEHPELAKHVDLIAAHVLPYWEFIPVDKAGQFVFDRARDLKKMFPKKPLLLSEVGWPSNGRMRGGADASPADQAIYLRTLVNKLNRQGFNYFVIEAFDQPWKASDEGSVGAYWGVFNAARQQKFNFEGPVVAIPQWRVLAIGSVVLALLSLTLLMIDGSALRQRGRTFLTFIAFLCGSVLVWIGYDYSQQYSTWFSLTVGFLLALGALGVFIVLLTEAHELAEAVWIHKRRREFLPVVGDSDYRPKVSIHVPCYNEPPEMVKQTLNALANLDYPDFEVLIIDNNTKDPAVWEPVRDYCETLGPRFKFFHVSPLAGFKGGALNYLIPHTAKDAEVIAVIDSDYCVHPNWLKHMVPHFADPKIAVVQSPQDYRDQNESTFKKLCYAEYKGFFHIGMVTRNDRDAIIQHGTMTMTRRSVLEELGWADWCICEDAELGLRVFEKGLSAAYYHDSYGKGLMPDTFIDFKKQRFRWAYGAIQIIKRHTRSLLRGKDTELTRGQRYHFLAGWLPWVADGMNIFFTVGALLWSAAMIIVPQRVDPPLLIFAIPPLALFVFKVGKIIFLYRRAVGVNLKDAFCAALAGLALSHTIAKAVLYGFFTSSIPFFRTPKNADNHGFWVAISEAREELFIMLLLWGAALGIFLVQGIPSNDMRFWVAMLLVQSLPYVAALIMAFLSSLPKPAAAPEPAPVV

SEQ ID NO: 13077 - protein, 489 aa, Streptomyces coelicolor A3(2)
MSKDAVDTAQVAAHPQATGTIPADAGDAGYSKDLKARHVNMIAIGGAIGTGLFLGAGGRLRDAGPALAIAYLVAGVFAFFVVKALGELVLYRPSSGSFVSYAREFLGEKGAYVAGWMYFLNWSTTGIADITAIALYTHYWSMFTSIPQWVLALVALAVVLAVNLISVKIFGEMEFWFAIVKVATLVGFMLIGIFLLATQHEVSGQTPGMGMITDHGGILPHGVMPVVLVMQGVIFSYAALELVGVAAGETAEPHKIVPRAVNSIMWRVALFYVGSVVLLALLLPSSLYSGDESPFVTVLSGIGVPAAGDVMNLVVLTAAMSSLNSGLYSTGRILRSMAMAGSAPRFTGVMSRSQVPYGGILLTCAVCVLGVGLNYLVPSKAFEIVLNVASLGIISTWVIIMICHLVFVRRARAGLVERPGFRLPGSPVTEIVTIAFLLAVVGLMWNDEEVGRKTVLLVPVIAVMLVAGWFGVRRRVAHQAGQERPAPRE

SEQ ID NO: 13078 - protein, 419 aa, Corynebacterium glutamicum ATCC 13032
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 13079 - protein, 455 aa, Gymnogongrus sp. HugheyJ_6.vii.96
MVKDTDVLALFRVSPQPGVDPIEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERFLYAMEGVNRSIAASGEVKGHYLNVTAATMEEMYERAEFAKQIGSIIIMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDYVAEGPQILQDAAKTCGPLQTALDLWKDITFNYTSTDTADFVETPTANV

SEQ ID NO: 13080 - protein, 394 aa, Oryza sativa
  unsure (1)..(394): unsure at all Xaa locations
FFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFXLGFGIGGDYPLSATIMSKYASKKTRRAFIAAVFAMQGFGILFGAIVALVVSADFRHAYPAPSYNPRTPPASLAPQAXDYTWRAHPSMFGHHPXAGLTYYWRIKMPETARYTTLVARNAKQAAADMSKVLHAEIEERPEVVESQVIAGETWGLFSRQLMKRHGMHLLATTSTWFLLDIAFYSQNLFQKNIFSKVGWIPPAKTMNALEELYRISRAQALIALCGTIPGYWFTVAFIDIVGRFWIQIVGFFMMTVFMLALGVPYDHXTHPAHHTGFVVLYALTFFFANFGPN

SEQ ID NO: 13081 - protein, 511 aa, Nicotiana tabacum
MMIDLELSTSLLFCLIPFLFLLFIKTTLANLFSSNKSTSKIPKSYPIIGSCFSILANKERRIQWTSDIMQNTSNLTFTLNRPFGFRQIFTANPANVQHMLKTQFHIYQKGDVFKTTMADFLGDGIFNVDGDIWKYQRQVSSHEFNTKSLRKFVETVVDTELNERLIPILATAAVEKTVLDFQDILQRFAFDNICKIAFGYDPAYLLPSLPQAKFAVAFEEAVKLSSERFNAIFPFVWKIKRNFNIGSEKKIRVAVNEVRQFAKELVKEKQKELKEKSSLDSVDLLSRFLSSGHSDEDFVTDIVISFILAGRDTTSAALTWFFWLIFEHPETENQILKEAKAKSESPVYDEVKDMIYTHASLCESMRFYPPIPIDTKAATEDNILPDGTFVKKGTRVSYHIYAMGRVENLWGKDWAEFRPERWLDKDEASGNWTFVARDTYTYPVFQAGPRICLGKEMAFLQMKRVVAGVLRRFKVVPLAEKGVEPVFLSYLTAKMKGGFPVTIEERNGTDI

SEQ ID NO: 13082 - protein, 759 aa, Arabidopsis thaliana
MWKLKIAEGGSPWLRTTNNHVGRQFWEFDPNLGTPEDLAAVEEARKSFSDNRFVQKHSADLLMRLQFSRENLISPVLPQVKIEDTDDVTEEMVETTLKRGLDFYSTIQAHDGHWPGDYGGPMFLLPGLIITLSITGALNTVLSEQHKQEMRRYLYNHQNEDGGWGLHIEGPSTMFGSVLNYVTLRLLGEGPNDGDGDMEKGRDWILNHGGATNITSWGKMWLSVLGAFEWSGNNPLPPEIWLLPYFLPIHPGRMWCHCRMVYLPMSYLYGKRFVGPITSTVLSLRKELFTVPYHEVNWNEARNLCAKEDLYYPHPLVQDILWASLHKIVEPVLMRWPGANLREKAIRTAIEHIHYEDENTRYICIGPVNKVLNMLCCWVEDPNSEAFKLHLPRIHDFLWLAEDGMKMQGYNGSQLWDTGFAIQAILATNLVEEYGPVLEKAHSFVKNSQVLEDCPGDLNYWYRHISKGAWPFSTADHGWPISDCTAEGLKAALLLSKVPKAIVGEPIDAKRLYEAVNVIISLQNADGGLATYELTRSYPWLELINPAETFGDIVIDYPYVECTSAAIQALISFRKLYPGHRKKEVDECIEKAVKFIESIQAADGSWYGSWAVCFTYGTWFGVKGLVAVGKTLKNSPHVAKACEFLLSKQQPSGGWGESYLSCQDKVYSNLDGNRSHVVNTAWAMLALIGAGQAEVDRKPLHRAARYLINAQMENGDFPQQEIMGVFNRNCMITYAAYRNIFPIWALGEYRCQVLLQQGE

SEQ ID NO: 13083 - protein, 317 aa, Staphylococcus epidermidis ATCC 12228
MKMEKEQAHWIYKTMNEIRFFEEKVHKIFSDGRIPGFVHLYVGEEAVATGVMSQLNDDDYITSTHRGHGHAIAKGCDLNGMMAEIMGKRDGLGHGKGGSMHVAEIDKGMLGANGIVSGGFGLAIGASISIINQGKDNVAVCFFGDGAANEGNFHEGLNFASILDLPVLFICENNQFAEGTTHDYASASETIAERAAAYNMPGVRVDGMDVVEVYKATQEAVERAKKGEGPTLIECDTYRKYGHFEGDEQKVKSPDDRNADKNATVEFRKRAIEENWLTEKEADEIEKAAEQAVEDAVKFAEESELPDEDSLYKDVFA

SEQ ID NO: 13084 - protein, 356 aa, Callistephus chinensis
MAAPISLKWEEHSLHENKFVRDEDERPKVPYNTFSNEIPVISLAGIDGCRRAEICDEIVKACEDWGIFQVVDHGVDTKLLSDMTGLARDFFHLPTQEKLRFDMTGGKKGGFIVSSHLQGEAVQDWREIVTYFSYPIKARDYSRWPDKPNEWRAVTEEYSKVLMGLACKLLEVLSEAMGLEKEALTKACVDMDQKVVVNYYPKCPQPDLTLGLKRHTDPGTITLLLQDQVGGLQATRDGGESWITVKPVEGAFVVNLGDHGHYLSNGRFKNADHQAVVNSSTSRLSIATFQNPAPEAIVYPLKINEGEKSIMEEPMTFMEMYKKKMSTDLELARLKKLAKDKQQDLEVVKPIQNIFA

SEQ ID NO: 13085 - protein, 165 aa, Rhizobium etli
MNPMQANAQQLIQDLKQRLLQEVVSEQDCHIGIAPISIALLSVKAQLDDASVEIATVARDVSRMAGTGAYTGEVSADLLVDSGIQFVLIGHSERREIFGDNPQILSDKIHYALNANMTIIYCVGESLEQRESGQAEQIVLQQICDVASVVKAEQWHNIIIAYEPI

SEQ ID NO: 13086 - protein, 558 aa, Mycobacterium tuberculosis H37Rv
MKVMAQMAMVMNLDKCIGCHTCSVTCKQAWTNRSGTEYVWFNNVETRPGVGYPRTYEDQERWRGGWVRDKKGRLRLRDGGRIHKLLRIFANPKLPTIGDYYEPWTYDYENLTSAPAGDTFPTAAPRSLISGNPMKVSWGSNWDDNLAGSPEIVPNDPVLKKVNQVNQEVKLKLEETFMFYLPRICEHCLNPSCVASCPSGAMYKRTEDGIVLVDQDRCRGWRMCVSGCPYKKVYFNHKTGKAEKCTLCYPRIEVGLPTVCSETCVGRLRYLGLVLYDVDQVLQAASVESDTDLYEAQRRILLDPHDPRVIAGARAEGIADEWIEAAQRSPVYALINTYRVALPLHPEYRTMPMVWYIPPLSPVVDAVSRDGHDGEDLGNLFGALDALRIPIAYLAELFTAGDTEVVAGVLRRLAAMRCYMRDINLGRETQPHIPESVGMTEEQIYQMYRLLAVAKYEERYVIPTSYAGELPAAAMTDDMGCSLSVDGGPGMYESGPFGQGSPTPVPIAVESFHALQHAGSAATGGAGRSRVNLLNWDPNGAAAGLFPEPQPSKDVVQR

SEQ ID NO: 13087 - protein, 354 aa, Stylosanthes humilis
MASSKAFGWAAKDASGHLSPFHFTRRQNEADDVTLKILYCGVCHSDLHTVKNDWGFTTYPVVPGHEIAGIVTKVGSNVTKFKEGDRVGVGVIVDSCQECECCQQDLESYCPKPVFTYNSPYKGTRTQGGYSDFVVVHQRFVLQFPDNLPLDAGAPLLCAGITVYSPMKYYGMTEPGKHLGVAGLGGLGHVAIKFGKAFGLKVTVISSSPNKESEAIDVLGADSFLLSSDPEKMKAATGTMDYIIDTISAVHSLVSLLGLLKLNGKLVTVGLPSKPLQLPIFPLVAGRKLIGGSNFGGLKETQEMLDFCGKHNIAANIELIKMDEINTAIERLSKADVKYRFVIDVANSLSSSNM

SEQ ID NO: 13088 - protein, 335 aa, Glycine max
  unsure (1)..(335): unsure at all Xaa locations
VASVCFTEDGFPYGIYNKAVNLTADHNVITRYVYSSFWGFQQISTLAGNLTPSYFVWEVLFTLXIIGSGLLLFALLIGNIQNFLQALGRRRLEMPLRRRDVEQWMSHRRLPEDLRRRVRQAERYSWAATRGVNEEILLENLPEDLQTDIRRHLFKFVKKVRIFSLMDEPILDAICERLKQKTYIKGSKVLSQGGLVEKMVFVVRGKLESFGDDGTIVPLSEGDACGEELLTWYLEHSSVSTDGKKLRVQGQRFLSNRTIRCLTNVEAFSLHAADLEELTILFTRFLRNPHVLGALRNVSPYWRSLAANRIQVAWRYRKKRLSRANTSQSNQTLMS

SEQ ID NO: 13089 - protein, 393 aa, Chlamydia muridarum
MKRNPNFTSLTQNYLFSDLRNRIAQFHSENPQHQVINLSIGDTTQPLDTSVAEAFSQAIARFSSPSTYCGYGPDFGLPSLRQKLSEKLYHGCVNAEEIFISDGAKVDLFRLLSFFGPNQIVAVQDPSYPAYIDIARLTGAKEIVSLPCLQENDFLPVFPENTHIDILCLCSPNNPTGTALNKNQLRAIVRYAIEHNILILFDAAYSAFISAPSLPKSIFEIPDARFCAIEINSFSKSLGFAGIRLGWTVIPKELTYEDGQPIIRDWKRFLSTTFNGASIPAQEAATAGLSTLSKLEAVHYYKENSHLLKTSLLKAGFQVFGGEHAPYLWVKPTIETVPYRDLFDFFLQEYHIAITPGIGFGLCGSGFVRFSSLGKREDVLVACERLQMTPALQ

SEQ ID NO: 13090 - protein, 1754 aa, Zea mays
MEYSAKTSLPLYTFGIIFPCRCQRFNTNQQKEQVRLQKKGAKRKPKCSLVWCTRLSSVPPDSVRCTTRQCPVHQGESAQTPQLRVSEAQLRYNSPDCPVCHWTVRCTSGATTIYAQRSTLTDEQCSTVSRQKSEQQRMIEMAADVGLLGRVLPNKAKQRYSLYADDVGVFIRADKEDLKVLKKILEVFEGFSRLKINFDKTEIFPIRYPQTLWPDLMDVFPGKYSKFPREYLGLPLHFRNVRRIDVQPLIGKINKRLAGWKGRLLSKADLFNASTIVTIGNGKMADFWGSSWIEGHAPKNIAPKLYKKARRKNISVFKALRNNYWMQFCAPFSREEEPASLSLGDWVLQSLQFPPALPVLPHAPLCLSVSLASLLQTPARRPGRGGVMVFKGRFFSSRHKSSESSSSPDGSNSPRTPTSAPASASAASPASSSSSRSDKKKTKSETPKKRDKLFGSAATAPKSAASSASSSPAGDGRKGSVPHHRDAGVGGGGGASAAALSPILASSLGLNRIKTRSGPLPQEGQRMAAVIGSSNLSRGQGQAEPSAASAGVGGRKGVTSWADTSSSSRGKGKTTELPMRSTAGTSLGPVGKSAVKAKPSAQRNHSGDLRTPTHIPEAACAYDPCETPKESESPRFKAIMQATSAPRKRLPADIKSFSHELNSKGVRPFPFLKPRGIYNLKEVIKVIHVRFEKAKEEVNSDLAVFAGDLVSVMEKYADSHPEWKDALEDLLILARTCCVMTPGEFWLQCEGIVQDLDDHRQELSMGVLKKLYTRMLFILTRCTRLLQFHKESGFAEDEVVIDQRDKIIQSADRQILTQSGVGDTTSRASKSEARKSYSQEQHNLKWKRSQEIKPVNLLPPLDTDVKKVADSPTKERISSWKPFPSPVTKVPKESTPTKLESPNKKTDAHSTVSSHVELSSPVESLPQQQLPVKHQHKTSWGHWSDQPNISEEGSIMCRICEEYVPTQYVEDHSRVCAIADRCDKKGVSVDERLIRVAEMLEKMVESYSPKDLPNAAVSPDVAKVSSSSINEESDGPSPKLSDWSRRGSADMLDYLQETDNTISLDDIKNLPSMTCKTRFGPKSDHGMATSSAGSMTPRSPLTPRSNHIDMLLAGKNAINESGDLPQEARLPTSGIRAMVIVGDVPRRERFRRSASTHMTFLNAQGCDGAHADLLQGLTRLSVQEAEGQGAAAGARGRAGVGWREERAGLAAPERKIVELADIARCIANTPLDEESALSQMVTCIEDLQEIVNRRKHEALTVQTFGTRIEKLHREKYLQLCDSVDMDKVDSASTIMDEEDDVVRSLRASPVHPVKDRTSIDDFEIMKPISRGAFGRVFLAKKRTTGDLFAIKFYVLVSPSDPQYVYSKQVLRKADMIRKNAVESILAERDILITVRNPFVVRFFYSFTSRENLYLVMEYLNGGDLYSLLRNLGCLDEDVARVYLAEVVLALEYLHSMHIVHRDLKPDNLLIAHDGHIRLEKLTDFGLSKVGLINSTDLSGPAVSGASLYGDDEPQMNELEQMDHRARRQNRSAVGTPDYLAPEILLGTGHGCSADWWSVGVILFELIVGIPPFNAEHPEAIFENIMNRKIPWPHVPEEMSFDAQDLIDRLLTEDPHQRLGANGASEVKQHPFFKDISWDTLARQKAAFVPSSDSAFDTSYFTSRYSWNQSDENIYEAYELEDSSDNGSLSGSSSCVSNQDDMGEDSTGLNEFESSANVNYSFSNFSFKNLSQLASINYDLLTKGLKDDPPPRTEM

SEQ ID NO: 13091 - protein, 490 aa, Escherichia coli K12
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 13092 - protein, 477 aa, Zea mays
  unsure (1)..(477): unsure at all Xaa locations
TSALAPARPRRGRGDARPICYSRRRRRDLAVIKDVGVAXGRIRRAGSVALGDFLRREASAERAALGGGERPSVAAGQACRAKKGEDFALLKPACERRPGAPSTSFSAFALFDGHNGSAAAVYAEEHLLANVLGCVPADLSRDDWLAALPRALVAGFVKTDKDFQTKAHSSGTTVTLAIIDGSVVTVASVGDSRCVLDAAGSIYYLSADHRFDANEEEVGRVTECGGEVGRLNVVGGAEIGPLRCWPGGLCLSRSIGDQDVGEFIIPVPYVKQIKLSNAGGRLIISSDGVWDALTAEMAFRCARGLPPEAAAEQIVKEAVESKGLRDDTTCIVIDIIPPEKQKCTIESPKTPGKGLVLLKNFFLRKTASGSLSLADKDNYPEPDFVEEVFEDGCPSLSRRLNSEYPVRDMFKLFACAICQIDLESGQGISIHEGSSKTGKLRPWDGPFLCHSCQEKKEAMEGKRHSRDSSSRNSGSSE

SEQ ID NO: 13093 - protein, 491 aa, Pseudomonas putida
MKHYRNYVNGKWTESSRTFDDVSPVDGSLVAIVHEASRELVDEAVKSGHQALSGEWGRTTATQRVALLRRIADEMERRQGDFLAAEMADTGKPHSMASSIDVPRGIANFRTFADILATAPVDSHRLDLADGAYALNYSARKPLGVVGVISPWNLPLLLMTWKVAPALACGNTVVVKPSEDTPGTATLLAEVMEAAGVPPGVFNLVHGFGPNSAGEFISSHPDISAITFTGESRTGTTIMRAAAEGVKPVSFELGGKNAAIIFADCDFDKMLDTMMRALFLNSGQVCLCSERVYVERPLYDRFCAALVERIKGMKIDWPQDPATQMGPLISAKHRDKVLGYFELARTEGATFLAGGGVPHFGDSRDDGAWVQPTVITGLGDDARSVREEIFGPICHVSVFDNEQEVIARANDTRYGLAATIWTSNLGRAHRVSEAMRVGISWVNTWFLRDLRTPFGGAGLSGIGREGGMHSLNFYSELTNVCIRIDEEVADV

SEQ ID NO: 13094 - protein, 350 aa, Pseudomonas putida KT2440
MTYFIDVPTMSDLVHDIGVAPFIGELAAALRDDFKRWQAFDKSARVASHSEVGVIELMPVADKSRYAFKYVNGHPANTARNLHTVMAFGVLADVDSGYPVLLSELTIATALRTAATSLMAAQALARPNARKMALIGNGAQSEFQALAFHKHLGIEEIVAYDTDPLATAKLIANLKEYSGLTIRRASSVAEAVKGVDIITTVTADKAYATIITPDMLEPGMHLNAVGGDCPGKTELHADVLRNARVFVEYEPQTRIEGEIQQLPADFPVVDLWRVLRGETEGRQSDSQVTVFDSVGFALEDYTVLRYVLQQAEKRGMGTKIDLVPWVEDDPKDLFSHTRGRAGKRRIRRVA

SEQ ID NO: 13095 - protein, 473 aa, Synechocystis sp. PCC 6803
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGQTENSSYYFADSVEGRWNTGREEEGGNLGYKPGYKQGYFPVAPTDTAQDIRTEMLLTMAGLCVPIEKHHHEVASGGQNELGIKFDKLVNSADNLMIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 13096 - protein, 323 aa, Corynebacterium efficiens YS-314
MQKRYGSLGWLPMNLLITALTPVIWATTYYVTTEFLPPGRPILAGVLRALPAGLIILAWFRVLPRGQWWWKATVLGVVNIGAFFGFLFWTAYLLPGGVAAVVTNTAPLWVIGLAPLILGTRLKGMQVIAGVVAIIGVAALVLGPGVQLNTLGVLTGLGGSLCMAFGIILAKKFGTPEGVPGLAVTGWQLTIGGLFLVPFLLIEGLPDHLTATNIGGYAYLGLIGGAFAYGIWFRGIALLDPVQVAMLGILSPLTATLIGVVFNDERLSPVQWAGGVAVVVALLLANLASVPGRGGRGRRQPGVDKLIPELTPGAEAPPRRSDR

SEQ ID NO: 13097 - protein, 175 aa, Triticum aestivum; identical to SEQ ID NO: 6942

SEQ ID NO: 13098 - protein, 529 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFSYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPRSVKHLKKFLLRLR

SEQ ID NO: 13099 - protein, 340 aa, Oryza sativa
MASAASVEEPAAAAAAAAETKRGPSGASFIREHLRSLAPYQPILPFEVLSARLGRKPEDIIKLDANENPYGPPPEVAKALGNLKFPYVYPDPESRQLRAALAEDSGLESEYILAGCGADELIDLIMRCVLEPGDKIVDCPPTFTMYEFDASVNGALVIKVPRLPDFSLDVAQIVKVVEQEKPKSIFLTSPNNPDGSIINDEDLFKILDLPILVVLDEAYIEFSSLQTRMSWVKKHDNLIVLRTFSKRAGLAGLRVGYGAFPLSIIEYLWRAKQPYNVSVAAEVSACAALQNPTYLEEDLAKMGVMIRHYDKKELKGYIRISVGKPEHTDALMKGLKALQL

SEQ ID NO: 13100 - protein, 399 aa, Archaeoglobus fulgidus
MIIEDVHYRVVFDSRGNETVECEVVAGEVVAKAMAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 13101 - protein, 323 aa, Streptomyces coelicolor A3(2)
MTHTEQQPLNSPFSAATTAEDVMAGHDLSGVTAVVTGGYSGLGLASTRALTAAGARVLVPARRPDIARAALRDVKGSEVVPMDLTDLDGVRSAAAHIGDRIDRIDLLMAAAGVMATPERRVGPGWEFQLAANHFGHFTLACELYPLLAAAGGARVVAYSSAGHAMTDIRRHDPHFRTGYDRWLAYGQAKTANALFAVHLDALGKDDGIRAFALHPGKIITGLQREMPLQEQIDAGWVDEHGNVVAADFKTASQGAATGLWAATSPLLDGRGGLYLADCDVARVFPPDTPMDDNGVRPYAVEPANAARLWEMSLAATGATPPTR

SEQ ID NO: 13102 - protein, 318 aa, Apodachlya brachynema
SKVGINGFGRIGRLVLRAAENNPLINVVAVNDPFIPTNYMEYMLKHDTVHGMFNGTVSHEGDHIIVNGRKVRVFGERDPQNIKWSDCDIEYVVESTGAFTTLEKASAHLKNGPKKVVISAPSADAPMFVMGVNHQLYTNNMNVVSNASCTTNCLAPLAKVVNDSFGIKEGLMTTVHAVTASQLSVDGPSKKDWRGGRAACFNIIPSSTGAAKAVGKVIPELNGKLTGMSFRVPTADVSVVDLTCRLNNKASYDEIKAAIKYASENELKGILGYTDAAVVSSDFITDSRSSIFDASAGIALTDDFVKLVSWYDNEWGYS

SEQ ID NO: 13103 - protein, 509 aa, Vicia faba
MLQRSRTLPSKIYQGVIEERKDGRHYIELEPLPKMETETKPITIQSKCLDDDGRVKRTGTFWTASAHIITAVIGSGVLSLSWAIAQLGWAVGPVVMVLFAVVNLYTSTLLTQCYRSDDSVAGPRNYTYTDAVKSILGGKKFKICGVIQYVNLFGVAIGYTIAASVSMMAIKRSNCYHESHGNDPCHMSSNVYMIAFGIAEVILSQIPDFDQVWWLSIVAAIMSFTYSAVGLGLGVAKVAENGTFHGRLMGISIGTVTPAGTVTGTQKVWRSLQALGAMAFAYSFSIILIEIQDTIKSPPAEHKTMKKATMLSIMVTTVFYILCGSMGYAAFGDHVPGNLLTGFGFYNPYWLLDIANFAIVVHLVGAYQVFSQPFFAFVEKWSAHKWPKNKFVTEEYDIPIPCIGVYKLNLFRLIWRTIFVLLTTLIAMLLPFFNDVVGLLGAFGFWPLTVYFPIDMYISQKKIGRWTNRWLGLQMLSGCCLIISTLAAVGSIAGVVLDLKTYKPFKTSY

SEQ ID NO: 13104 - protein, 302 aa, Vibrio fischeri
SVLRALYESDKRDKIEVVVVNELSQPEAMAHLFQYDSTHGRFQHKVTHDQEYLYIDLPNGSQDKVRILHQADLSLLPWQSLEIDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMYDQQVIDAYHSDLRRTRAASQSIIPVDTKLHKGIERIFPKFSNKLEAISVRVPTVNVTAMDLSVTINTNVKVNDINQTIVNASRCTLHNIVDYTEAPLVSIDFNHDPHSAIVDGSQTRVSNGHLVKM

SEQ ID NO: 13105 - protein, 266 aa, Zea mays
  unsure (1)..(266): unsure at all Xaa locations
MVLEATMICIDNSEWMRNGDYAPSRFQAQADAVNLICGXKTQSNPENTVGVMTMAGKGVRVLVTPTSDLGKILACMHGLEVGAEANLAAAIQVAQLALKHRQNKRQQXQRIIAFIGSPVKYDKKVLETIGKKLKKNNVALDIVDFGESDDEKPEKLEALXAAVNSSDSSHIVHIPPGENALSDVLLSTPIFTGXKKGGXSGFAASAAAAAATGASGFXNLGVDPNVDPELALCPCGCLWKEERARQEAIAKKAAEDTSNTEHNNVP

SEQ ID NO: 13106 - protein, 193 aa, Glycine max
MFAEENGLKGDPRLQAISQAIRVVPHFPKHGIMFQDITTLLLDHKAFKDTVDIFVDRYRDMHISVVAGIEARGFMFGPSIALGIGAKFVPLRKPRKLPGEVISEKYALEYGTDCLELHVGAVQPGERAIIIDDLVATGGTMSAGVKLLERVGAEVVECACVIGVPDVKGQCRRIGKPLYVLVEPRKADKCYPD

SEQ ID NO: 13107 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 13108 - protein, 293 aa, Zea mays
TNLDSWTPDQLKMMAFGGNNRAHAFFKQHGWTDGGKVEAKYTSRAAELYRQMLNKEVAKSAITDNALPSSPVTLSDAPAPPAENLNGKHEPKSPKSAPRSPKAATHPTFATSVKKPIGAKKVGGKTGGLGVRKLTTKPNESLYEQKPEEPKPAIPALTAPTAKGGPSLHSRFEYVDNEQSSVSRTGGSGSRVTGHVAPPKSSDFFQEYGMGNGFQKKSSNASKAQQIEETDEARKKFSNAKAISSSQFFGTQNREEKEAQLSLQKFAGSSSISSSDLFGRTNVDDSNLDLSAA

SEQ ID NO: 13109 - protein, 405 aa, Corynebacterium glutamicum ATCC 13032
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 13110 - protein, 419 aa, Capsicum annuum
MAFSSLLKPTASLVRPSHRSQASCVGLQHSSNSVKLQSAIFGDVVSIAQSSSLQNSGACSIQPIRATATELPPTVPKSQTGGKTRVGINGFGRIGRLVLRIATFRDDIEVVAVNDPFIDAKYMAYMLKYDSTHGVFRGSISVLDDTTLEINGKQIKVSSKRDPADIPWGDLGADYVVESSGIFTTVDRASGHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLNKSASYDDVKAAIKYASEGPLKGILGYTNEDVVSNDFVGDSRSSIFDAKAGIGLSKSFMKLVSWYDNEWGYSTRVLDLIEHMALVAATS

SEQ ID NO: 13111 - protein, 933 aa, Vibrio vulnificus CMCP6
MRNPAIEKAQQALVSVSRQAAAEGIVLLKNDDQALPIEPSQVLSLFGRCQMDTYRSGTGSGGAVNVPYAVTALQGLQANPTIQLNTSLIALYQDWLAHHPFDDGGGGWAAEPWFQHEMPLTDEVVAQAASQSDKAVVFIGRTAGEDKDYADEAGSYRLTELETDMLTKVCRHFSCVIVVMNVTNIIDMSWLTRLENHQAIKAVLYSWAAGMEGGHALADVLSGAVSPSGRLTDTIAHRLQDYPSSAHFGRKDFNLYAEDIYVGYRYFETFAPEAVQFEFGAGLSYSQFERRLVQCSSDVADAGGDLTNAKSLYFEIEVRNIGQQFSSKEVVQLYVEAPQGQLGKPARALCGFAKTSELAPNCSEVVRISVPVALLASFDDSGASGYPNSYVLEAGQYHFYLGGSVRQAQKIDATWWVEHTTSLETLSEACAPTREFERLVPAERHANGVYQPRYQPVPQRTVDLAQRIEANLPPTYAFTGDQGIKLADVAQGRASLEAFVAQLTAEQLAILVRGEGMCSPKVTPGTAAAFGGVCTSLFEFGIPVAAAADGPSGIRMDSGHQATQVPIGTLLACTWNTELNQQLYYLLGQELQAYQIDTLLGPGINIHRHPLNGRNFEYFSEDPLLTGWIAAAQTTGLKQAGVSGTIKHFAANDQETARVDVDSVMSQRALREIHIKPFEMAVKYGQASTIMTAYNPVNGHWAASNYDLNTTILRGEWGYTGIVMTDWWAKMNHPVDGGEESKRFTGYMLRAQNDLYMVVENDAAERNPMDDDTLHALAHGELTLGELQRSAMNICRFILQAPVMQRPLQAYQAVKPFAPLADALPDAAPLLPVTQRMVVNSQNHCELWVEVAQAGHYLCFAEMAYDREPLAQSSCSLSINGEFAMSLPTNGTEGKTVEIEGIAIHLQAGIYRIDTQFVKKGAELKTLRFEGQA

SEQ ID NO: 13112 - protein, 530 aa, Oryza sativa (japonica cultivar-group)
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGSLIGAKFGFSGVADIPKAYAAFVVLFICAYVAGFAWSWGPLGWLVPSEIFPLEIRSAGQSINVSVNMLFTFIIAQAFLPMLCRFKFILFFFFGAWVVIMTLFVAFFLPETKNVPIEEMVLVWKSHWYWGRFIRDEDVHVGADVEMPAAGNRNGKVDPAKLAN

SEQ ID NO: 13113 - protein, 82 aa, Glycine max
FDHVFEEPQAHAQTQGSLLQQIDCNGACAARCRLSSRPRLCQRACGTCCRRCNCVPPGTAGNQEVCPCYASLTTHGGKRKCP

SEQ ID NO: 13114 - protein, 185 aa, Glycine max
MAKGKHTHTRAQGKKWSTFSLVLWALFFLTLILVVLLALGIVYLPTTDDDFPTTDLSAFRRKTSQSAESLVENPPPEQWTEILSWEPRAFIYHNFLVSFPYLLMSKEECEYLIELAKPQMVKSSVVDSKTGKSTESRVRTSSGMFLKRGKDKIVQNIEKRIADFTFIPEENGEGLQILHYEVGQK

SEQ ID NO: 13115 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFGVKFYNRGGNFDLVGNNVPVFFNRDAKSFPDTIRALKPNPKSHIQEDWRTLDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYFPSRFDPCRPAEQYPIPACVLNGRRTNCVIPKENNSKQAGERYRSWESDRQDRYINKWVESLSDPRVTHEIRSIWISYLSQADKSCGQKVASRLTVKPTM

SEQ ID NO: 13116 - protein, 196 aa, Rhodospirillum rubrum
MFLLIDNYDSFTYNLWHYLGELGAEVEVRRNDALDAEAALALAPQGIILSPGPCDPDRAGICLDLVAKAAKARVPVLGVCLGHQTIGQVFGGAVVRAPKPMHGKVDAIHHQGHGIFAGMPMPFPATRYHSLVVRRDDLPDCLEVTAWSDDGLIMGLAHKDLPIEGVQFHPESIETQGGHHLLRNFLTLARQGGDAV

SEQ ID NO: 13117 - protein, 511 aa, Zea mays
  unsure (1)..(511): unsure at all Xaa locations
MDSPPLQPTVFSLILALILVLYLALRRRGGGKNRSYPPVAGTVLHQLFNFGRLMEYQTALSRRYRTFRMLTPTCSYIYTVEPANVEYILKANFGNYGKGSTLHELREDLLGDGIFNVDGAKWRHQRKVASHEFSTRVLRDYSTGVFRDTAAELAGIVAAAAAAAGEKLDMQELLMRSTLDSIFXRVGFGVSLGVLSGSSEEGAAFAKAFDDASEQVLRRFLDPFWKAKRFLNLSSEAAMKRSLRTINGFVYAVVDRKIEQMERDQQEFVSPEDITSPFLVERESDPGCSDNKYLRDIILNFVIAGRDTTAGTLSWFLYVLCRNQHVQDRIAQEVRAAASGDRDDVGVQEFVACLTEDAISRMRYLHAALTETLRLYPAVPIDVKCCFSDDTLPDGYAVKKGDMVNYQPYQMGRMRFLWGADAEEFRPERWLDDAGVFVPESPFKFTAFQAGPRVCLGKEFAYRQMKIFAAVLLYLFRFEMWDANATVGYRAMLTLKIDRPLYSSYVAPAMR

SEQ ID NO: 13118 - protein, 479 aa, Bolidomonas mediterranea
KSDRYESGVIPYAKMGYWDAAYSVKETDILALFRITPQPGVDPVEAAAAVAGESSTATWTVVWTDLLTACERYRAKAYRVDPVPNTTDQYFAFIAYECDLFEEGSLANLTASIIGNVFGFKAVSALRLEDMRIPHSYLKTFQGPATGIIVERERLDKYGRPVLGATVKPKLGLSGKNYGRVVYEGLKGGLDFLKDDENINSQPFMRWRERYLYCMEGINRAAAATGEVKGSYLNVTAGNMDEVIKRSEYAKAVGSVIIMIDLVMGYTAIQTAAIWARENDMILHLHRAGNSTYARQKNHGINFRVICKWMRMAGVDHIHAGTVVGKLEGDPLMIKGFYDVLRLSSLEVNLPYGIFFEMDWASLRKVMPVASGGIHAGQMHQLVYYLGDDVVLQFGGGTIGHPDGIQAGATANRVALEAMIMARNEGADIFNNEVGPQILRDAAKTCGPLQTALDLWKDISFNYTSTDTADFVETPTANV

SEQ ID NO: 13119 - protein, 622 aa, Shigella flexneri 2a str. 301
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANPEVLHALNPMWAVHFFLEYKTVSFIALGAVVLSITGGEVLYADMGHFGKFSIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVILLTLRTEDAPYVHNVRRVQIEQLSPTFWRVVASYGWRETPNVEEVFHRCGLEGLSCRMMETSFFMSHESLILGKRPWYLRLRGKLYLLLQRNALRAPDQFEIPPNRVIELGTQVEI

SEQ ID NO: 13120 - protein, 101 aa, Triticum aestivum
MSGVTADEDKKPAGDGGGAHINLKVKGQDGNEVFFRIKRSTQLKKLMNAYCDRQSVDLNSIAFLFDGRRLRGEQTPDELEMEEGDEIDAMLHQTGGGFPRP

SEQ ID NO: 13121 - protein, 440 aa, Tuber borchii
MITKIHARSVYDSRGNPTVEVDLTTTDTGLHRAIVPSGASTGQHEAIELRDKDKTKWAGKGVLKAVENVNTIIAPALIKEKFDVKDQATIDKFLIDLDGTPNKAKLGANAILGVSLAVAKAGAAAKKVPLYAHVADLAGTKKPFVLPVPFMNVINGGSHAGGRLAFQEFMIVPSEAPSFTEAMRQGAEVYQILKTLTKKKYGQSAGNVGDEGGWPDIQTVEEALDLITDAIDKAGYTGQIKIAMDVASSEFYKEDAKKYDLDFKNPDSDSSKWLTYQELADLYKSLAQRYPIVSIEDPFAEDDWEAWAHFYKTSDFQIVGDDLTVTNPIRIKRAIDEKSCNALLLKVNQIATLTESIQAAKDSYSAGWGVMVSHRSGETEDVTIADIVVGLRAGQIKTGAPARSERLAKLNQILRIEEELGEQAIYAGTSSEPPHLYIFI

SEQ ID NO: 13122 - protein, 201 aa, Pseudomonas aeruginosa UCBPP-PA14
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKNLGVFAGLANPLTVTRYHSLVVKRESLPECLEITAWTQHADGSLDEIMGVRHKTLNVEGVQFHPESILTEQGHELLANFLRQQGGVRGEGN

SEQ ID NO: 13123 - protein, 243 aa, Triticum aestivum
  unsure (1)..(243): unsure at all Xaa locations
MATGAACYYHPAAGRGSPSSLSPGLGSSQSKVFFISSGGRSSSRWWMRRRRGEGKASCGSINSSSRARARPALFSPAMEWQECSTEIEVDVPCSVAYQCYSERETIPQWMPFISTVKVLEDKPELSRWTLKYAILGRDVEFSWLARXNMTPTKNQKIHWRSLEGLPNRGAVRFFPKSSSSCRVQLTVAYEVPEILTPVASXKLSNPTILFHQALKPFXEGLLFNGLERFVAFAKERYSKSLQS

SEQ ID NO: 13124 - protein, 334 aa, Nostoc punctiforme
MSKNLLEQLREVTVVVADTGDIQAIEKFKPQDATTNPSLITAAAQMPEYQGIVDQTLLQAKKDAGDGATQAQIVSLAFDRLAVAFGLKILQIIPGRVSTEVDARLSYDTEATLTKARDLIAQYKAAGIGRDRVLIKIASTWEGIRAAEILEKEGIHCNLTLLFGLHQAIACAEAGVTLISPFVGRILDWYKKDTGRDSYPATEDPGVLSVTKIYNYYKKFGYKTEVMGASFRNLGEITELAGSDLLTISPSLLAELQSTVAELPRKLDPAKAASLSIEKISIDKASYDKMHAADRMATDKLDEGIKGFTKALEDLEKLLADRLVRLEGEVVASH

SEQ ID NO: 13125 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRKNKANPVALLLSSAMMLRHLQFPSFADRLETAVKKVISEGKCRTKDLGGQSTTQEVVDAVIAKLE

SEQ ID NO: 13126 - protein, 374 aa, Ralstonia metallidurans
MAGQDNAADYFGPSYVRKISPYIAGKPISEVAREFGLDEARIVKLASNENPLGMPASAKAAIAAATEDLGRYPDSNGFELKAKLSEKYDVPAEWLTLGNGSNDILELAAHALVRNGESIVYAEYSFAVYALATQEVGARAIEVKSRAYGHDLDAMAAAIAPDTKLVFIANPNNPTGTFVSAAEIEAFLAKVPPHVVVVLDEAYNEYLDAGQQYESVAWVRKYPNLMVSRTFSKAYGLAGLRVGYGVAQPQLTDLLNRVRQPFNVNSLAQAAAVAALDDTAFLQRSAELNRQGKARLVEAFERSGLEYVKSSGNFVMVRVGGDDGAGARVNLALLKQGVIVRPVANYGLPQWLRVTIGLPEENDAFIAALEQALK

SEQ ID NO: 13127 - protein, 362 aa, Triticum aestivum; identical to SEQ ID NO: 8432

SEQ ID NO: 13128 - protein, 313 aa, Pseudanabaena sp.
NGFGRIGRNFLRCWAGRTDTNIELVGLNDTSDPRTNAHLLKYDSMLGKFAGDVSADDTTITVNGKTIKTVSDRNPDNLPWKDWVIDLVIESTGVFIDKEGASRHINAGAKKVLITAPGKNEDGTYVVGVNEDQYNHDIHNIISNASCTTNCLAPVAKVLLENFGIVKGVMTTTHSYTGDQRLLDASHGDLRRARAAALSIVPTSTGAAKAVALVLPELAGKLNGIALRVPTPNVSVVDFVVEVEKKAIAQEVNEAFRAAAEGPMKGILEYNELPLVSIDYRGTDASSIVDSSLTMVMGGNMVKVVAWYDNEWG

SEQ ID NO: 13129 - protein, 170 aa, Triticum aestivum
  unsure (1)..(170): unsure at all Xaa locations
MAPTVMASSATSVAPFQGLKSTAGLPVSRRSNGASLGSVSNGGRIRCMQVWPIXEGIKNSETLSYLPPLNTXGLLKQVDYLIXRSKWGAFPPIQQVXSSSREXTISLGYYDGPVIGTMLELPKFGVHWTHTVITKVEEVXEXIPDPYFPSIGQIVKCMRQLIASNCKIRG

SEQ ID NO: 13130 - protein, 503 aa, Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 13131 - protein, 483 aa, Zea mays
  unsure (1)..(483): unsure at all Xaa locations
MRINVCGCRGSTVHLHHLSSSSSPPPLPFHLLPPGDSSSSLPRRSIGPPIDRARGRRFQSGVVSIRSGSLPVWVGAMAAMDASADKNAVFRKLRAKSDNKMCFDCNAKNPTWASVTYGVFLCIDCSAAHRSLGVHVSFVRSTNLDSWTPEQLKMMVYGGNNRAQAFFKQHGWTDGGKIEAKYTSRAADLYRQLLAKDVAKSSTEDGNNSWPSSPVAASQAPNQAAAFPDLKLTEVSKENVSEKKDSEIVRSPRAPTHSFKKPIGAKKPGNKTGGLGARKLTSKPNESLYEQKPEEPAPVLPSSVIESTTTRSKSHTSRFDYVENAPALKNGNSSEGNHMSGHVAPPMSSNFFAEFGMDSGYXKKSTSSSSKVQIEESREARQKFSNAKSISSSQFFGDQASFEKDAQVSLQKFSGSSAISSADLFGHPANNSSVDLSASDLINRISFQATQDLSSLKNMAGETGKKLTSMASNIITDLQDRIL

SEQ ID NO: 13132 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDCEGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 13133 - protein, 349 aa, Myxococcus xanthus
MIPVRGYAAQDAKSPLAPFQFERREPGPSDVQIEILYCGVCHSDLHQVRDEWGGSRFPMVPGHEIIGRVVRVGDQVKKVKVGDMAGVGCMVDSCRTCPSCQEGLEQYCEKGNVQTYNGKEKDGQTATQGGYSEAIVVDEAFTLKIPENLDPAAAAPLLCAGITTYSPLRHWKVQPGQRVGVVGLGGLGHMGVKLAKAMGAHVTVFSHTDSKKQDATRLGADAVVVSSNKEEMAAQTGGFDFILDTVSAQHDINAYLRLLRRDGHLVLVGAPEKPLDVRPFSLIPTRRSFSGSMIGGIQETQEMLDFCGKHNIVSDIELISIQQVNDAYERLLKGDVKYRFVIDLASLRK

SEQ ID NO: 13134 - protein, 109 aa, Oryza sativa
MMVMVPCVWCKSMILEMDTYRYHGHSMSDPGSTYRTRDEIAGIRQERDPIERVRKLLLAHDFATTQELKDMEKEIRKQVDTAIAKAKESPMPDPSELFTNVYVNDCGLE

SEQ ID NO: 13135 - protein, 269 aa, Pimpinella brachycarpa
MGRQPCCDKLGVKKGPWTADEDNKLINFILTNGQCCWRAVPKLAGLRRCGKSCRLRWTNYLRPDLKRGLLTDAEEQLVIDLHARLGNRWSKIAGRLPGRTDNEIKNHWNTHIKKKLIKMGIDPVTHEPLHKEETNSQKEILLQPFQSPAETENHVPPIPHTNDMASSENSCTPTDQNSSGDESNSLSAICDQIDDSLISYLFEDDTPGLVDAPWENFNKVDMVLPSWDESFPWLLDCQDFGIQDFGFDCFNDIEMNMLTQLDVKNDQTG

SEQ ID NO: 13136 - protein, 350 aa, Bradyrhizobium japonicum USDA 110
MSRFWSPVVRTLSPYVPGEQPKQDGVVKLNTNENPYPPSPRVLAAIASAAERLRLYPDPRATRLREAIAAYCDVAAEQVFVGNGSDEVLAHTFPALLKHDRPLLFPDVTYSFYPVYCRLYGVAHEEVPLDAAMRIEIADYRRPSSAILLCNPNAPTGIALPRDAVAALLAENPDRLVVVDEAYVDFGAESAVPLVAHHDNLLVIQTFSKSRALAGLRVGFAIGQRPLIEALERVKDSFNSYPVDCLAIAGAVAAIEDEAWFLESRTRIIASRDVLTRDLAQLGFEVLPSLANFVFARHRRRSGADLAAALRQRGVLVRHFKKPRIEDFLRITVGTDEQCGRLIEVLRELI

SEQ ID NO: 13137 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 13138 - protein, 377 aa, Saccharomyces cerevisiae
MPHSVTPSIEQDSLKIAILGAAGGIGQSLSLLLKAQLQYQLKESNRSVTHIHLALYDVNQEAINGVTADLSHIDTPISVSSHSPAGGIENCLHNASIVVIPAGVPRKPGMTRDDLFNVNAGIISQLGDSIAECCDLSKVFVLVISNPVNSLVPVMVSNILKNHPQSRNSGIERRIMGVTKLDIVRASTFLREINIESGLTPRVNSMPDVPVIGGHSGETIIPLFSQSNFLSRLNEDQLKYLIHRVQYGGDEVVKAKNGKGSATLSMAHAGYKCVVQFVSLLLGNIEQIHGTYYVPLKDANNFPIAPGADQLLPLVDGADYFAIPLTITTKGVSYVDYDIVNRMNDMERNQMLPICVSQLKKNIDKGLEFVASRSASS

SEQ ID NO: 13139 - protein, 316 aa, Arabidopsis thaliana
MDSRIFLAFSLCFLFTLPLISSAPNRFLTRSSNTRDGSVIKMKTSASSFGFDPTRVTQLSWTPRVFLYEGFLSDEECDHFIKLAKGKLEKSMVADNDSGESVESEVRTSSGMFLSKRQDDIVSNVEAKLAAWTFLPEENGESMQILHYENGQKYEPHFDYFHDQANLELGGHRIATVLMYLSNVEKGGETVFPMWKGKATQLKDDSWTECAKQGYAVKPRKGDALLFFNLHPNATTDSNSLHGSCPVVEGEKWSATRWIHVKSFERAFNKQSGCMDENVSCEKWAKAGECQKNPTYMVGSDKDHGYCRKSCKACSS

SEQ ID NO: 13140 - protein, 316 aa, Pseudomonas aeruginosa PAO1
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 13141 - protein, 165 aa, Triticum aestivum
MAQEGLRLVCPPVSAHEGRLPRQYTLEGQGAKKDISPPLEWYGVPDGTRSLAVVVQDIDADERVPWTHWVVANISPEEKGLPEGFSGAGGNANAGSGAGGVQEGVNDWKQPGWRGPVPDSHGHRIQFRLYALDDVLSLGNKVTVDKVMEAIEGHVLGEAEITAVF

SEQ ID NO: 13142 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 13143 - protein, 430 aa, Bacillus subtilis
MPYIVDVYAREVLDSRGNPTVEVEVYTETGAFGRALVPSGASTGQYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 13144 - protein, 62 aa, Brassica rapa
ATLKMIVSKYPNLKGINFDLPHVIEDAPSHPGVEHVGGDMFVSVPKGDAIFMKWICHDWSDE

SEQ ID NO: 13145 - protein, 123 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAA

SEQ ID NO: 13146 - protein, 686 aa, Bacillus circulans
APDTSVSNKQNFSTDVIYQIFNDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSSYEDGIYRNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 13147 - protein, 643 aa, Bradyrhizobium japonicum USDA 110
MTSDVAVPAPETAAANGHGEAHTTAGFGALTLGSIGVVYGDIGTSPLYAFREAVTAASSGTDGLATPAAVLGVLSLILWALIVVVTLKYVVILLRADNNGEGGTLALMALAQRAVGTGGATIVLLGIISGALFYGDAVITPALSVLSAIEGMKDVTLRFEPYIVPLTVIILVGLFAVQSRGTARVAAFFGPIMCVWFAVIAVAAIHPIIAQPQVLFALNPLYAVSFMLHHGIIGFVTLGAVFLAVTGAEALYADLGHFGKRPIQTAWLFIVLPSLALNYLGQGALVLGDPGAIESPFFQLFPQGWIRGAMVVLATAATVIASQAVITGAYSLTRQAIQLGLLPRFEIRHTSEAHSGQIFIPRINQLLLVAVVLLVLLFRSSSALASAYGISVTGTMVVTAMMGFVVIWKVWRWSPLAAAALIAPFLFLDLTFLAANLLKVFEGGWVPLALGALMIILMYTWRRGSRLLFEKSRKLEFPLADLVAMLEKRPPQRVPGTAVFLTSDPLSAPTALMHSLKHYKVLHEKNVILTIETAQTPRIDPAERVRLEQISPTFSKVTLKFGFMESPNVPKALAIARKLGWQFDIMSTSFFLSRRALKPAAHSGMPRWQDRLFISLSRSANDATDYFQIPSGRVVEVGTQVTI

SEQ ID NO: 13148 - protein, 318 aa, Musa acuminata
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHADAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 13149 - protein, 552 aa, Xylella fastidiosa Temecula1
MKALFRACRIGKVMLRYRLDTLLDGTAVERWLRLAKPFVPRISAEIVEQSRGRRLRLALQELGPIFVKFGQILSTRRDLVPQDIGDELVMLQDRVEPFEGQTARSIIETALGKSVESAFAHFDTVPLASASISQVHAATLHDRRAVVVKVLRPDIEHQISDDIALLKSLATLVEHTHPNADKIRPREIVAEIETTLAAELDLQREGANASVLRRFWEASDDIYVPEVIWSHTAERVLTLERMYGIPSDDIALLDASGIDRKALSSKGIRVFYTQVFRDNFFHADAHSGNIWVDSDPARKSNPRFIVLDFGIMGQLSQKDQYYLAENFMAIFHKDYRRIAELHVEAGWIPPHVRIEELEAAARSVCEPYFTRPLSQISLAEVMMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGTIPVWSLISGCIGALALFSAWWRS

SEQ ID NO: 13150 - protein, 553 aa, Nierembergia caerulea
MAFDFGTLLGKMNNLTTSDHQSVVSVNLFVALICACIVIGHLLEENRWMNESITALVIGSCTGVIILLISGGKNSHILVFSEDLFFIYLLPPIIFNAGFQVKKKSFFRNFSTIMLFGAVGTLISFIIISAGAIGIFKKMDIGHLEIGDYLAIGAIFAATDSVCTLQVLNQEETPLLYSLVFGEGVVNDATSVVLFNAVQNFDLSHISTGKALQLIGNFLYLFASSTFLGVAVGLLSAFIIKKLYFGRHSTDREVAIMILMAYLSYMLAELFYLSGILTVFFCGIVMSHYTWHNVTESSRVTTKHTFATLSFIAEIFIFLYVGMDALDIEKWKFVSDSPGTSIKVSSILLGLVLVGRGAFVFPLSFLSNLTKKNPEDKISFNQQVTIWWAGLMRGAVSMALAYNQFTRGGHTQLRANAIMITSTITVVLFSTVVFGLMTKPLILLLLPSQKHLIRMISSEPMTPKSFIVPLLDSTQDSEADLGRHVPRPHSLRMLLSTPSHTVHYYWRKFDNAFMRPVFGGRGFVPFVPGSPTEPVEPTEPRPAESRPTEPTDE

SEQ ID NO: 13151 - protein, 149 aa, Glycine max
MASSTALSPVAFKSSFSTLPSRPARTRINVQGAFCLPCSTWKRASNRSFRVYSLFGGKKDKDENGDEAPSKGGLFGNIGNMQNLYETVKKAQMVVQVEAVRVQKELAATEIEGYCEGELIKVTLSGNQQPINVEITEAAMELGAEKVSE

SEQ ID NO: 13152 - protein, 488 aa, Xanthobacter flavus
MGADAAIGQIKDAKKRYAAGVLKYAQMGYWDGDYQPKDTDILALFRVTPQDGVDPVEAAAAVAGESSTATWTVVWTDRLTAADMYRAKAYKVEPVPGQPGQYFCWVAYELDLFEEGSIANLTASIIGNVFSFKPLKACRLEDMRLPVAYVKTFRGPPTGIVVERERLDKFGRPLLGATTKPKLGLSGKNYGRVVYEGLKGGLDFVKDDENINSQPFMHWRDRFLYCMEAVNKAQAETGEVKGHYLNITAGTMEEMYRRADFAKELGSVVVMVDLIVGWTAIQSISNWCRENDMLLHMHRAGHGTYTRQKGHGISFRVIAKWLRLAGVDHLHTGTAVGKLEGDPMTVQGYYNVCREDVTRTDYTRGIFFDQDWAGLRKVMPVASGGIHAGQMHQLIDLFGEDVVLQFGGGTIGHPDGIQAGAIANRVALETMILARNEGRDIKNEGPEILVEAAKWCQPLRAALDTWGEVTFNYASTDTSDFVPTASVA

SEQ ID NO: 13153 - protein, 328 aa, Medicago sativa
NSNEFGNFIAIDDELKLPEDQPEPMTLEHTEPMHSDPLEMEEVEMEDIEGEMILDIDSCDANNSLAVVEYIEDLHAYYRKIEYLGCVSPTYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKLMLNTLQYNMSLPTAYVFMRRFLKAAQADKKLELVAFFLVDLSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 13154 - protein, 491 aa, Burkholderia fungorum
MKRYQLFIDNEWVDPHSGAWFETDDPFTGEPWAEIPRADPTDADRAVRAAEKALEGPWSTLSASERGMLMYKLGALIERDAEHLATIESRDNGKLFRDVLGQMKYMAKYYYYFGGLADKIQGAVVPIDKPGIFNFIRYEPMGVVLSITPWNSSLPLTTWKMAPALCAGNTIVCKPSEFTSASLFELAKLFVEAGFPRGVFNVVTGFGPEIGASLVSHPGVARIAFTGGDEAGRKIYAAAAQHLKRVSLELGGKSPNIVFDDADLDQAVNGVISGIFSATGQTCVAGSRVLLQESIHDAFVERVAKLTRAAKVGNPLDPASEIGPITTKPQFEKILGYIDIATREGARCVAGGRALSGPGYGAGRFVEPTVFVDVTNDMRIAQEEVFGPVLSIIRFKDEEDAIRIGNDIKFGLAAGVWTNSLHRAMLMSQRLKAGTVWINNYRSSSFTTPFGGFKQSGIGREGGIESVKEFMEAKSVWMSSDLKMPALFAGK

SEQ ID NO: 13155 - protein, 335 aa, Microbulbifer degradans 2-40
MPRIAINGFGRIGRNVLRAIYERNLQNEMQVVAINDLGSPDINAHLLKYDTVHGRFGFDVEASEGAIRVNGDEIKITAERNPADLPWAALNVDIVFECTGLFVARDKAALHLDAGAKNVLISAPGKDVDLTVVYGVNHESITADHKVLSNASCTTNCLAPMTSALHSAIGVKTGLMNTIHSYTNDQRVTDAYHSDTLRARAAALNMIPTKTGAAAAIGLVIPDLAGKLDGLSIRVPTVNVSCLDFTFEAARDTTVEEVNQVLRDAAAGPLKGVMDVNTIPLVSSDFNHDAHSCIVDLSHTRVMGNQVKVLAWYDNEWGFSNRMLDTTMAIVKANA

SEQ ID NO: 13156 - protein, 337 aa, Zea mays
MGKIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTSCLAPLAKVIHDNLGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVFWYDNEWGYSNRVVDLIRHMFKTQ

SEQ ID NO: 13157 - protein, 696 aa, Glycine max
MWRLKIAEGGNEAYIFSTNNFVGRQTWEFDPEAGTPEERAQVEAARKDFYHHRFKVKPCADLLWRFQILRENNFKQTIPSVKIEDGEEITYQKVTSTVRRGAHHLAALQTSDGHWPAQIAGPLFFLPPLVFCMYITGHLESVFPEEHRKEILRYIYYHQILGVFDWCGSNPMPPEFWILPSFLPMHPAKMWCYCRLVYMPMSYLYGKRFVGPITPLILQLREELFTQPYEKVNWKKARHQYAKEDLYYPHPLVQDLIWDSLYIFTEPLLTRWPFNKLIREKALQVTMKHIHYEDETSRYITIGCVEKVLCMLACWVEDPNGDAFKKHLARIPDYLWVSEDGMTMQSFGSQEWDAGFAVQAFLATNLIEEIGPTLAKGHDFIKKSQVKDNPLGDFKSMYRHISKGSWTFSDQDHGWQVSDCTAESLKCCLLLSMLPPEIVGEKMEPERLYDSVNVLLSLQSKKGGLAAWELAGAQEWLELLNPTEFFADIVVEHEYVECTGSAIQALVLFKNLYPGHRKKEIENFIANAVRFLEDTQTADGSWYGNWGVCFTYGSWFALGGLAAAGKTYINCAAIRKAVKFLLSTQREDGGWGESYLSSPKKIYVPLEGSRSNVVHTAWALMGLIHAGQADRDPKPLHRAAKLLINSQLEEGDWPQQEITGVFMKNCMLHYPMYRDIYPMWALAEYRRRVPLPSTEV

SEQ ID NO: 13158 - protein, 497 aa, Pseudomonas aeruginosa PAO1
MTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 13159 - protein, 233 aa, Thinopyrum elongatum
DSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRGAFVFPLSFLSNLTKKTELEKISWRQQIVIWWAGLM

SEQ ID NO: 13160 - protein, 504 aa, Novosphingobium aromaticivorans
MNDMTTISRTQREYSEAAKAFLARKPQLFINNEWVDSSHDAVIEVEDPSNGRIVGHVVDASDKDVDRAVAAARAAFDDGRWSNLPPMVRDRTMNRLADLLEANADLFAELEAIDNGKPKGMAGAVDIPGAISQLRFMAGWASKVAGETTQPYTMPNGTVFSYTVKEPVGVCAQIVPWNFPLLMASLKIAPALAAGCTLVLKPAEQTSLTALKLADLVVEAGFPAGVINIITGNGHTAGDRMVKHPDVDKVAFTGSTEIGKLINRNATTTLKRVTLELGGKSPVVVMPDVDVAQTAPGVAGAIFFNAGQVCVAGSRLYAHRSVFDSVLEGMTQTAPFWAPRPSLDPEAHMGPLVSKEQHDRVMGYIEAGKRDGASVVMGGDCPSADGGYYVNPTILADVNPQMSVVREEIFGPVVVAQRFDDLDEVAKMANDTCFGLGAGVWTRDVAVMHKLASKIKSGTVWGNCHALIDTALPFGGYKESGLGREQGRAGIDAYLETKTVIIQM

SEQ ID NO: 13161 - protein, 356 aa, Schizosaccharomyces pombe
MWGFIVTCGIFLVLLCQLRLLSKRKSKSTPYNALLPNVTVFAMGGTIAGCANSSLEIVNYIPGSVGIEKLIEAVPAIKAIANINGVQVTNMGSENLTPADVLKLAKLILAEVAKPNVHGIVITHGTDSLEETAMFLDLTISTAKPIVVVGAMRPSTAIGADGPMNLLNAVAVASSNQSMGRGTLVLLNDRIGSAFYTTKTNGNTLDTFKSYEAGSLGIVLNQKPFYFFSPAVPTGKVFFDIYNIKQLPRVDILYGYQGLNPKLAESAVHLGAKGLVLAAMGATSWTDDGNEVISSLIREHNIPVVYSHRTAEGYSSNSCLGIPSYFLNPQKARYMLMLAISSGYSIRDIEDLFSIK

SEQ ID NO: 13162 - protein, 198 aa, Streptococcus pneumoniae
GIEDILVVTGKSKRSIEDHFDSNFELEYNLKEKGKTDLLKLVEEATGMRLHFIRQTHPRGLGDAILQAKAFVGNEPFVVMLGDDLMDITDEKAVPLTKQLMNDYEKTHASTIAVMPVPHEDVSSYGVIAPQDEGSNGLYSVETFVEKPAPEETPSDLAIIGRYLLTPEIFEILEKQAPGAGNEIQLTDAIDTLNKTQR

SEQ ID NO: 13163 - protein, 427 aa, Coxiella burnetii
MTELTGVSIVTYQHIKVPSQGEKITVNKAVLEVPDRPIIPFIEGDGIGIDITPVMKNVVDAAAEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 13164 - protein, 354 aa, Triticum aestivum
CTPQQAAAAHLFAHAVTLQPPMASACDRLRYLKAFDDTKAGVKGLIDAGITTVPAIFRHPPDTLARAHDEDRFAIPVIDLAGVTTAPSRRAELVAEVKAAAETVGFFQVLFHGAPPPVMSEMLAALRSFNEEPAEARRPYYSRDGQSRVRYHSNFDLFRSPAAIWRDTLYLDMAPTGPSPGEIPPACRGIAVEFTREVQRLGGTLFELLSEALGLHRGFLEQREAGCLEGLSVVGHYYPASPQPHLTMGTSRHTDPSFLTVLLQDSVGGLQVLHRLRRDDQPVWVDVPAEPGAFTVNVGDFLQLLSNDRFRSVEHRVLSKSVGPRVSVACFFRPHGAAAAARVCAPILVGDGAA

SEQ ID NO: 13165 - protein, 390 aa, Hordeum vulgare
MQDTSSTQHKSLPNNIIEMDMVTSMPLEANSNGQILQAEAELFCHSFGYLKSMALQSVVKLRIPDVLHRYGGAASLPELLSTVPIHPNKLPYLPRLMKMLAAAGIFTAEDVPATVGDGEPTTLYHLNAVSRLLVDDASVNGGASMSPCVLLGTVPLFLGASLKLHEWLQSEEQATTETPFMLAHGGTLYGIGGRDSEFNTVFNKAMGASSEFVAALAVRECRDVFAGIKSLVDVAGGNGTTARTIAEAFPYVKCSVLDLPQVIQGISSHGTVEFVAGDMMEFVPPAEAVLLKYVLHNWSDQDCVKILTRCREAISPGEKAGKVIIIDTVVGSPSQQILESQVTMDLSMMMLFNGKVREEQNWHKIFLEAGFSHYKIHNVLGMRSLIEVQP

SEQ ID NO: 13166 - protein, 341 aa, Desulfovibrio desulfuricans G20
MKKSSTPPDLILYTPARRPMLCLTFTPASRSRAGRLPQPEYGTRFLQFHAGISMIYLKLVLSALIWGGTFVAGRLAAAELGPFSCAFLRFAMASVCLTFLARLQEGGLPALTRKTLPGVLLLGLSGVFAYNAFFFLGLQTVAAGRAAVIIALNPVFIALFAALLLREPLSGLRLTGIALSVCGAITVISRADPLALFTHALSAGDMAIFGCVASWVTYSLAGRKVMADLSPLASVTWSCITGALMLFPFALSEGLPARMGSISLTTWTSITYLALLGTVAAFTWFYQGVKAIGASRAGVFINIVPVSAILLAALLLDEPVALSLLGGAVLVGCGVWLTNRH

SEQ ID NO: 13167 - protein, 603 aa, Schizosaccharomyces pombe
MKISDKLLHPDWKEKVTYSYEFFPPKTSTGVQNLYNRIDRMKTWGRPMFVDVTWGAGGTSSELTPGIVNVIQTDFEVDTCMHLTCTNMSTEMIDAALKRAHETGCRNILALRGDPVKDTDWTEGESGFRYASDLVRYIRTHYNDEFCIGVAGYPEGYSPDDDIDESIKHLKLKVDEGADFIVTQMFYDVDNFIAWVDKVRAAGINIPIFPGIMPIQAWDSFIRRAKWSGVKIPQHFMDTLVPVKDDDEGVRERGVELIVEMCRKLIASGITRLHFYTMNLEKAVKMIIERLGLLDENLAPIVDTNNVELTNASSQDRRINEGVRPIFWRTRNESYVSRTDQWDELPHGRWGDSRSPAFGEFDAIRYGLRMSPKEITTSWGSPKSYSEIGDLFARYCEKKISSLPWSDLPISDEADLIRDQLLSMNRNAFLTINSQPALNGEKSSHPVFGWGPPNGYVFQKPYVEFFVHPSLLNELKETVKKLNSVSYFVTNKNGDLDTNSQYEIPNAVTWGVFPNREIIQPTIVESTSFLAWKDEAYSLGMEWANAYSPDSISRKLLVSMMKEWFLCVIVDNDFQNGQSLFDVFNKMRSLKDIHPELYYANAS

SEQ ID NO: 13168 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 13169 - protein, 355 aa, Streptomyces griseus
MKALVLAGGTGTRLRPITHTSAKQLVPVANKPVLFYGLEAIRAAGIIDVGIVVGDTADEIVAAVGDGSRFGLKVSYIPQSKPLGLAHCVLISRDFLGEDDFIMYLGDNFVVGVVEDSVREFRAARPDAHLMLTRVPEPRSFGVAELSDSGQVLGLEEKPAHPKSDLALVGVYLFSPAIHEAVAAITPSWRGELEITDAVQWLIDAGRDVRSTVISGYWKDTGNVTDMLEVNRLVLETTEPRCDGLVDERSDLIGRVLVEEGAEVRNSRVMGPTVIGAGTRVTNSYVGPFTSLAEDCVVEDSEVEFSIVLRGASISGVRRIEASLIGRHVQVTSAPEVPHAHRLVLGDHSRAQISS

SEQ ID NO: 13170 - protein, 494 aa, Thermus aquaticus
PLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGPKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 13171 - protein, 464 aa, Bachelotia antillarum
  unsure (1)..(464): unsure at all Xaa locations
KMGYXDADYNVKETDVLALFRITPXPGVDPVEAAAAVXGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLSGGLDFLKDDENINSQPFMRWKERFLYCMEGVNRAAAATGEVKGSYLNVTAATMENMYERAEYARSIGSVIIMIDLVVGYTAIQSMAIWARKAEMILHLHRAGNSTYARQKNHGINFRVICKWMRMCGVDHIHAGTVVGKLEGDPLMVKGFYNTLLLTELRINLPEGLFFDMDWASLRKCVPVASGGIHCGQMHQLIYYLGDDVVLQFGGGTIGHPDGIQAGATANRVALEAMVLARNEGRDYVGEGPQILRNAATTCGPLKAALDLWKDITFEYTSTDTPDFVEVATGTN

SEQ ID NO: 13172 - protein, 461 aa, Mesorhizobium sp. HN14A16
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 13173 - protein, 492 aa, Vitis vinifera
MDPYKYRPSSAYNSPYFTTNAGAPVYNNDSSLTVGSRGPVLLEDYHLVEKLANFQRERIPERVVHARGASAKGFFEVTHDVSDLTCADFLRAPGVQTPVIVRFSTVIHERGSPETIRDPRGFAVKFYTREGNFDMVGNNFPVFFIRDAMKFPDVIHAFKPNPKSHIQEYWRVVDFLSYHPESLSTFAFLFDDVGIPQDYRHMEGFGVHTFTLLNKAGKANYVKFHWKPTCGVKCLLEDEAIRVGGTNHSHATQDLYDSIKAGNYPEWKLFIQTMDPEHEDKFDFDPLDVTKTWPEDILPLQPVGRLVLNKNIDNFFAENEMLAFNPALVVPGIYYTNDKMLQGRIFAYSDTQRHRLGPNYLQLPVNAPKCAFHNNHHDGSMNFMHRDEEVDYFPSRFDPVRHAETFPIPSTICHGKREKVVIEKENNFKQPGERYRSFAPDRQERFINRWVETLSDPRVTYEIRSIWISYWSQADRSLGQKLASRLNVKPKY

SEQ ID NO: 13174 - protein, 446 aa, Methanococcus voltae
MTSLEMALEYIKINNVKFLRFQFVDIHGEPKNIAYPVKLGTADGEEELMGVLENGLFFDGSSIEGFVEIEDSDMVLKPDLSTLSVLPWRPSEKSVARIICDVYRKNGKPFEGDPRGCLKRVLAEFKEEFKGEYFVGPEPEFFILKNENGKWVPGDDAGYFELEPLDEGNDLRRNIVFALENLGFHVEASHHEVAPGQHEVDFKYDNAVKTADSVITFKTTIKTLAKQSGVLATFMPKPFFGMNGSGMHCNQSIWLDGKPSFYDENNAHQLSDICLSYIGGILEHTKALVSVTNPTVNSYKRLVPGYEAPVNIAWANSNRTSIIRVPAARGKGTRVEFRAPDPACNPYLAFTVMLAAGLDGVRRKLIAPEPVEKNIFAMSEAEKREANIDSVPSNLYDAIEELRQDKVLKKALGDHIFNKFIEIKTKEYDAYRTAVTDWEFNKYVRI

SEQ ID NO: 13175 - protein, 273 aa, Oryza sativa (japonica cultivar-group)
MATAARLLPKIQSPASPAVAEARRRRPSSLRLGVTSGPARTLKQKLVAKSAVSVVEGENAFDGVKQDTRPIIVIDNYDSFTYNLCQYMGEVGANFEVYRNDDITVEEIKKISPRGILISPGPGTPQDSGISLQTVQDLGPSTPLFGVCMGLQCIGEAFGGKVVRSPYGVVHGKGSLVHYEEKLDGTLFSGLPNPFQAGRYHSLVIEKDSFPHDALEITAWTDDGLIMAARHRKYKHIQGVQFHPESIITTEGRLMVKNFIKIIEGYEALNCLP

SEQ ID NO: 13176 - protein, 233 aa, Dechloromonas sp. RCB
MSAKDYVIAPSILSANFAKLGEEVANVIASGADWIHFDVMDNHYVPNLTIGPLVCEAIRPCTTAPIDVHLMVKPVDRIIPDFAKAGANIITFHPEASEHVDRSLSLIRDAGCKGGLVFNPATPLDYMDYVLDKIDVILLMSVNPGFGGQKFIPGTLAKAKQARAKLDAYERETGRRIRLEIDGGVNTANIAEIARAGVDAFVAGSAVYGAGKDSDPHRYDSIIGALRSELAKV

SEQ ID NO: 13177 - protein, 295 aa, Triticum aestivum
MAAAILRRLSPAAAQRASPLLPLARAVSDSTEPLTVETSVPFTSHIVDPPSRDAIITAYRDHCLYLARGRDLVAAFAELMGRVDGCSRGKGGSMHFYKKDANFYGGHGIVGAQVPLGCGLAFAQRYRKEGTVTFDLGGDGAANQGQLFEALNMAALWKLPVILVCENNHYGMGTAEWKASKSPAYYKRGDYVPGLKVDGMDFLAVKHACKFAKEHVLEIGPIILEMDTYRYHGHSMSDPGSTYRTRDEIAGIRQERDPIERVRKLLLTHDLATAQELKDMEKEIRNEVDTAIAKT

SEQ ID NO: 13178 - protein, 434 aa, Triticum aestivum
RPAGLPGGGGAWRAAGGRPVLPPAPGGFLKATGRLPSPGVLQVAPGPRLLGGTRQRDYPPEFRRWYVVLAENTTGAGVTGGGEINGQGGAFVVTPSAQKNVMVSWNATGDCLGDECRPRLLGFIDSKDVAVHDITLNQPALWCLHLVRCDNSVIRNVSIYGDFDTPNNDGIDIEDSNNTIITDCHIDTGDDAICPKSSTGPVYNLTATNCWIRTKSCAIKFGSASFFNFEKLLFDNITIVDSHRGLGMQIRDGGNVSDVTFSNIKMRTRYYHPSWWGRAEPIYITTCPRHPDSKEGTISDVRFINISSVSENGVFLAGSKHGLLRNLKFKNVDLTYKRWTNYTGGLYDYRPGCRKMVKHKTGGMMLEHISGLEGDNVSMRWWRGSLEGWDVNPLLFRPPTTGGLSLHPGLSLPVQPPTSGLSPLCRYVSCIHDE

SEQ ID NO: 13179 - protein, 127 aa, Trichodesmium erythraeum IMS101
MNITFEELNTIDKKLSKRHIDLDPGGYFIIFIDKKAGLIFAKHFTNIIDSRGLAIDPETGKPIPAKGKVERQENAIFTAKTAKEMCVKIFEETRPCHITMLDHAAYLGREFVRAEIALLSGKEYIQD

SEQ ID NO: 13180 - protein, 195 aa, Escherichia coli O157:H7 EDL933
MNTLRIGLVSISDRASSGVYQDKGIPALEEWLTSALTTPFELETRLIPDEQAIIEQTLCELVDEMSCHLVLTTGGTGPARRDVTPDATLAVADREMPGFGEQMRQISLHFVPTAILSRQVGVIRKQALILNLPGQPKSIKETLEGVKDAEGNVVVHGIFASVPYCIQLLEGPYVETAPEVVAAFRPKSARRDVSE

SEQ ID NO: 13181 - protein, 488 aa, Gelidium pusillum
MSNSVEERTRIKNERYESGVIPYAKMGYWDPDYAIKETDVLALFRVTPQPGVDPVEASAAVAGESSTATWTVVWTDLLTACDLYRAKAYKVEPVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKSHGMNFRVICKWMRMAGVDHIHAGTVVGKLEGDPLMIKGFYNTLLLTHLDVNLPQGIFFEQDWASLRKVTPVASGGIHCGQMHQLLDYLGVDVVLQFGGGTIGHPDGIQAGATANRVALEAIVIARNEGSDYVAEGPQILRDAAKTCGPLQTALDLWKDISFNYTSTDTADFVETPTANV

SEQ ID NO: 13182 - protein, 233 aa, Dianthus caryophyllus
MGRGRVELKRIENKINRQVTFAKRRNGLLKKAYELSVLCDAEVALIVFSNRGKLYEFCSTSCMNKTLERYQRCSYGSLETSQPSKETESSYQEYLKLKAKVDVLQRSHRNLLGEDLGELSTKELEQLEHQLDKSLRQIRSIKTQHMLDQLADLQKKEEMLFESNRALKTKLEESCASFRPNWDVRQPGDGFFEPLPLPCNNNLQIGYNEATQDQMNATTSAQNVHGFAQGWML

SEQ ID NO: 13183 - protein, 490 aa, Pseudomonas fluorescens PfO-1
MARFELQKLYIDGAYSDAGSDATFEAINPANGEVLAHVQRATKEDVERAVVSAEKGQKIWAAMTAMERSRILRRAVDILRERNDELAALETLDTGKAFSETKYVDIVTGADVLEYYAGLVPAIEGEQIPLRDTSFVYTRREPLGVVAGIGAWNYPIQIALWKSAPALAAGNAMIFKPSEVTSLTTLKLAEIYTEAGVPNGVFNVLTGSGREVGTWLTEHPRIEKISFTGGTDTGKKVMASASASSLKDVTMELGGKSPLIICDDADLDRAADTAMMANFYSSGQVCTNGTRVFVPSHLKAAFEAKIVERVARIRVGNPEDENTNFGPLVSFPHMESVLGYIAKGKEEGARVLCGGERLTDGEFAKGAFVAPTVFTDCTDDMTIVREEIFGPVMAILSYETEEEVIRRANDTDFGLAAGIVTRDLNRAHRVIHQLEAGICWINAWGESDAKMPVGGYKQSGVGRENGISSLNNFTRIKSVQVELGDYVSVF

SEQ ID NO: 13184 - protein, 552 aa, Shewanella oneidensis MR-1
MIRGADAVIKVLAAHGVTTVFGYPGGAIMPIYDALYGSPVEHLLSRHEQGAAFAAVGYARASGKTGVCFATSGPGATNLITSLADALLDSVPVVAITGQVSTAVIGTDAFQEIDVLGMSLSCTKHSFMVTDVNDLIPTLYQAFEIAASGRPGPVLVDIPKDIQIAHLEYRTPLLAVTNEPQAEMSDINAARALLAQAKQPMLYVGGGVGMAGAVDQLRDFINTTGMPSVATLKGLGSIAHGTPGYLGMLGMHGGKAANLAVQDCDLLVVAGARFDDRVTGRLATFANKAKVIHLDIDAAELGKLRQPDVAIAGDLRQIFPALAMSLNITPWQVEVEHLARKHQWDYQHPGSLIYAPAMLRRLANKLPEDSVVCCDVGQHQMWVAQHMWFRRPEDHLSSAGLGTMGFGLPAAIGAQVARPDATVVTVSGDGSFMMNVQELTTIKRRKLPVKILLIDNQKLGMVKQWQQLFFEGRYSETDLSDNPDFVQLASAFDIPGRTIFSSDEVEEALTEMLAAKGPYLLHVAIDDAFNVWPLVPPGASNSDMMDEMEKQT

SEQ ID NO: 13185 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 13186 - protein, 547 aa, Mycobacterium tuberculosis H37Rv
MSTDTAPAQTMHAGRLIARRLKASGIDTVFTLSGGHLFSIYDGCREEGIRLIDTRHEQTAAFAAEGWSKVTRVPGVAALTAGPGITNGMSAMAAAQQNQSPLVVLGGRAPALRWGMGSLQEIDHVPFVAPVARFAATAQSAENAGLLVDQALQAAVSAPSGVAFVDFPMDHAFSMSSDNGRPGALTELPAGPTPAGDALDRAAGLLSTAQRPVIMAGTNVWWGHAEAALLRLVEERHIPVLMNGMARGVVPADHRLAFSRARSKALGEADVALIVGVPMDFRLGFGGVFGSTTQLIVADRVEPAREHPRPVAAGLYGDLTATLSALAGSGGTDHQGWIEELATAETMARDLEKAELVDDRIPLHPMRVYAELAALLERDALVVIDAGDFGSYAGRMIDSYLPGCWLDSGPFGCLGSGPGYALAAKLARPQRQVVLLQGDGAFGFSGMEWDTLVRHNVAVVSVIGNNGIWGLEKHPMEALYGYSVVAELRPGTRYDEVVRALGGHGELVSVPAELRPALERAFASGLPAVVNVLTDPSVAYPRRSNLA

SEQ ID NO: 13187 - protein, 572 aa, Pseudomonas aeruginosa PAO1
MSSKKVAEIVVETLEAAGVRHCYGIVGDTLNHVTDAIHRSQIQWVHVRHEEAAAFAAGAESYISGRLTACAGSCGPGSLHFINGVYEAQRNRAPMVLIASQIVTPQLGMEFPQEVDFKAVYASCSVFCEQVHSPEQARRVVALACQAALNRRGVAVVILPADISQATVKDDLPFSVHFPQPVLRPSDAELQDVARLLAHGKKIGIYAGSGCQGAHDLLVALADRLKAPIAHTSRAKDFVEYDNPFNMGMTGMLGIESGFHMMTECDTLLLLGADFAWAQFYPQKATLIQVDRDGSHLGRRHPIDLGVVGDVIPTLEALLPLLEAREERSFLDECLEHRERSLRTLEKEEQAGKGELIHPQHLVSLLDQHASEDALFTADGGSAMVWLLRHIHSNGKRRTLTSLVHGTMANAMPQALGLKKAYPERQVISISGDGGLAMLLGDLLTAIQEKLPIKVVVLNNASLNFVELEQKVEGLLDNYTDLLNPDFARLAEVIGFHGRKVTRSEELEAAVQEFLAQPGPALLDVHTNPAELVMPPKIEFGQVADTALYAAKAVLSGRFKDVETLLVNNLLK

SEQ ID NO: 13188 - protein, 70 aa, Bacillus cereus
RSFFAWLPVPKGYTSEQFSDILLEKAHVAVAPGVGFGKHGEGYVRVGLLHAEDRLREAINRIDKLNFFKK

SEQ ID NO: 13189 - protein, 89 aa, Synechocystis sp. PCC 6803
MSLPAPETPLYNHPLPQLERWLMALGCQQDRGDRHCWLLHQGDWDAELSLDTEELVICYFPHQPQRKVVRSFKYSLSRQDVEAAVLEGP

SEQ ID NO: 13190 - protein, 427 aa, Batrachospermum spermatoinvolucrum
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSIEGVNRAQAAAGEIKGHYLNVTAATMEEMYERAEFAKELGSIICMIDLVIGYTAIQSMALWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 13191 - protein, 318 aa, Vibrio fischeri
WIGRIGRSVLRALYESDKCDKVEVVAVNELSQPEAMAHLFQYDSTHGRFQHKVTHDQEYLYIDLPDGSQDKVRILHQADLSLLPWQSLEVDLVLDCTGVYGSKSDSEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLCVTINTNVKVNDINQTIVNASRCTLHNIVDYTEAPLVSIDFNHDPHSAIVDGSQTRVSNGHLVKMLVWYDNEFG

SEQ ID NO: 13192 - protein, 263 aa, Zea mays
  unsure (1)..(263): unsure at all Xaa locations
MLLLKIFTALFFYITSIVSAADTSAWKSRSIYFVLTDRIARSSSDTGGSACGDLGNYCGGTFKGLESKLDYIKGLGFDAIWITPVVSNKAAGYHGYWAEDLYAVNSNYGTAADLKSLVAAAHAKGIYMMVDVVANHMGPGAITNNRPEPLNQASSYHTACNIDYSNQNSIEICQIAGLPDINTTKSEIRTLLNTWVNWLVKEYSFDGVRIDTVKHVEKDFWPGFSAATGVYSIGEVFDGXPTYLAEYAKLMPGLPHYAVYYPM

SEQ ID NO: 13193 - protein, 362 aa, GIBBERELLA ZEAE PH-1
MPFTVLSDRNVNHILDTLSPSDVIDLANALEKALTQYSCNNEQQYQPHRAVVDRDGQVSLFMPGTTGQLLGVKIVGITPSEKLKPSEAGLKSVLTLCDARGHAIGTLNAAALTAFRTALGSMLPYRFRRKTENIVVFGAGAQAMWHIRLALLLKEKDIKSVTIVNRSAERAQQLVESLKGNKQSPWPSHISLQVFDSKNDLESLVVDADVLFFTTPSTQPVFPASYLTSEKARSKTRYLAAIGSYRLDMQEIDPELLKTVIDHSGPFADVVYRGSVAVDSRDGCLQEAGELVKAEIPKDKMLEIGQLFQTKTKQNPDDLNKWLEDGFVIYKSVGTGVMDLAIGQELLRLAKIKNVGLTAEDF

SEQ ID NO: 13194 - protein, 395 aa, Oryza sativa
MKPQRLPLPPVPAAALLLLPVALLAALLLVVYPNEFALQASLAGAAACGDHQGGGGGGGVQAAPEFRLLIGVLTLPARYERRHLLRMVYALQQPAVASRARVDVRFVFCRVGSPEDRVLVSLEAMAYGDVVELDCPENMDNGKTHAYFSSVPRLFGGGEAAYDFVMKADDDTFFRLPELAESLSRAPRRDLYYGCMVPCDYVRGSNEYMSGMGYLLSWDLVEWIVAAAAEIEGRTGGPEDRTLYSWLRRGGRGRNRVDVKPAMYNFPGRHPCSHEFIPDTIAVHQLKDNRRWARTLQYFNFTAALKPFYPALGAGTTPRHRLRRRHWGAWATAAALSRLDPPVVALPCSDPLAAALPRLDPQAGALPHPDPSAVALPVPPHRDRRRTTSTVAAKA

SEQ ID NO: 13195 - protein, 488 aa, Myrionema strangulans
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATVEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATDMR

SEQ ID NO: 13196 - protein, 135 aa, Oryza sativa
  unsure (1)..(135): unsure at all Xaa locations
PSQPPRRPEHIGGERSHGCSKATMICIDHSEWMRNRDYSPSRFXQAQADPVHLICGRPDPVQPGRTPWGVMTMGPKGACPLLRHSHHSTSGKILPWYAPDLKLGAEANLGCSHSGCPSRALKASPRIRRPPPPDY

SEQ ID NO: 13197 - protein, 329 aa, Zea mays
MDWAAASGSPSWGAAATDPGPTMLSFAGPSSSAADAEVRLQDFAAGLAQSSRPTGAAPGAGRRSRAAVGGAGAEACSVDVCRSDLSRCREYHRLHKVCEAHSKAPVVVVGGQERRFCQQCSRFHMLSEFDEEKRSCRKRLDGHNRRRRKPQHDLTNLGGFFPYQVNQFEFPQTIPTVGQNSDAVHLVGRQQPFSISFSRTPPDEFPFPQGQGGGSSVLHHLHAARPGHHAEGSSSHTGSSTRDNALSGTLGPECALSLLSSSLRRPSTAGVPAVGQPQVTASSTTAAAVSQAATAAVATAAFAASAGHHVFVPDAMFEDPSQALPFSWQ

SEQ ID NO: 13198 - protein, 301 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADY

SEQ ID NO: 13199 - protein, 366 aa, Oryza sativa
  unsure (1)..(366): unsure at all Xaa locations
MEELEGHRGEGRLPPPPPLLPFPKVSVQVYTVPSSSTAASAAAAGGARQXCCTGDAGRRRRRRPRRXGVLDDPVKARIVSHPRYHRLLAAFLDCHKVGCPAEAAEEIAAAARVREARQRAAAAASRMPPAPEDPELDQFMEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 13200 - protein, 509 aa, Glycine max
  unsure (1)..(509): unsure at all Xaa locations
MSLPACPAEQLAQXLLGPNTTDASAAASLICGQFAAVDSKFVDTAFAVDNTYLLFSAYLVFSMQLGFAMLCAGSVRAKNTMNIMLTNVLDAAAGGLFYYLFGFAFAFGSPSNGFIGKHFFGLKDIPSSSYDYSYFLYQWAFAIAAAGITSGXIAERTQFVAYLIYSSFLTGFVYPVXVSHWFWSPDGWASAISSADHVFSPGDRLFSTGVIDFAGSGVVHMVGGIAGLWGALIEGPRMGRFDHAGRAVALRGHSASLVVLGTFLLWFGWYGFNPGSFNKILLTYGNSGNYYGQWSAVGRTAVTTTLAGSTAALTTLFGKRVISGHWNVTDVCNGLLGGFAAITAGCSVVEPWAAIVCGFVASIVLIACNKLAEKVKFDDPLEAAQLHGGCGTWGVIFTALFAKKEYVKEVYGLGRAHGLLMGGGGKLLAAHVIQILVIAGWVSATMGPLFWGLNKLKLLRISSEDELAGMDMTRHGGFAYAYEDDETHKHGMQLRRVGPNASSTPTTDE

SEQ ID NO: 13201 - protein, 203 aa, Fusobacterium nucleatum subsp. vincentii ATCC 49256
MFLMIDNYDSFVYNLVSYFLEENIEMEIIRNDLVDLKYIEDLIKKDKLEGIIISPGPKSPKDCGLCNEIVKQFYKKVPIFGVCLGHQIIGHVFGAEVKKGKSPVHGKVHKIKNSGKNIFKNLPKEFNVTRYHSLVVEKEKLLNDFNIEAETDDGVLMALSHKNYPLYSVQFHPEAVLTEYGHEMIRNFLDLAKKWRDKNAYRS

SEQ ID NO: 13202 - protein, 325 aa, Zea mays
  unsure (1)..(325): unsure at all Xaa locations
MSFSAARVSEHGGEFEEARGMPAEVSWEMLDKSRFFVLGAALFSGVSAALYPAVVLKTHLQVAAPAQAAASAAAAAILRRDGPRGFYRGFGASLAGTVPARALYMAALEATKSVVGSRRRPPPPPATAAVPTRSGRSYSRTACAACTAASXISVLTYAPSHAAPLAAARYRGGTDAFRKILLADGVRGLYRGFGISVLTYAPSSAAWWASYVTAQRLLWRAVGPAAHDSRGAAIALQGASAAAAGSAAALVTMPLDTVKTRLQVMDAGAQAPTLAAAARALVREGGWSACYRGLGPRWASMSLSSATMVTVYEFLKRLSAKEGSL

SEQ ID NO: 13203 - protein, 393 aa, Petroselinum crispum
EFAAAFWSPPAREDSSKLVMNRSDSEWAFQSFLQQASALESSQPLPSDPVPVAGDVKNPVEIPANVPVDSEDYQAYLKSRLDLACAAVALTRASSLKPQDSAALLDNGSQASNTSQLVSQVPPKGSGHDLSKEEDKEALAATATPLLPALQKKSAIQVKSTTSGSSRDHSDDDDELEGETETTRNGDPSDAKRVRRMLSNRESARRSRRRKQAHMTELETQVSQLRVENSSLLKRLTDISQRYNDAAVDNRVLKADIETMRAKVKMAEETVKRVTGLNPMFQSMSSEISTIGMQSFSGSPSDTSADTTQDGSKQHFYQPAPTSHMPAQDQKIQNGLLQVPPVDNLQQHSASGPVEGNKMERTSSMQRVASLEHLQKRIRGGVSSCEAQVSGKQ

SEQ ID NO: 13204 - protein, 470 aa, Bacillus subtilis subsp. subtilis str. 168
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 13205 - protein, 496 aa, Pseudomonas aeruginosa UCBPP-PA14
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQALATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 13206 - protein, 373 aa, Oryza sativa (japonica cultivar-group); identical to SEQ ID NO: 3690

SEQ ID NO: 13207 - protein, 175 aa, Secale cereale
  unsure (1)..(175): unsure at all Xaa locations
MAPAVMASSATTVAPFQGLKSTAGLPVGRRSGSAGLSSVSNGGRIRCMQVWPIEGIKKFETLSYLPPLSTEALLKQVDYLIRSKWVPCLEFSKVGFVFREHNNSPGYYDGRYWTMWKLPMFGCTDATQVLNEVEEVKKEYPDAYVRVIGFDNMRQVQCVSFIAFRPPXCEESGKA

SEQ ID NO: 13208 - protein, 322 aa, Oryza sativa; identical to SEQ ID NO: 1018

SEQ ID NO: 13209 - protein, 137 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAAR

SEQ ID NO: 13210 - protein, 293 aa, Glycine max
MKAKTVKGNWSLRTNKLSFPYVFLVCIFFFLAGFFGFTLFSHSQGDGDGLRPRQRLLEPGNEAEYNLMPVRDLGDDSITSIPFQVLSWRPRALYFPNFATAEQCENIIDVAKDGLKPSTLALRQGETEENTKGIRTSSGVFVSASEDKTGTLAVIEEKIARATMIPRSHGEAFNILRYEVDQRYNSHYDAFNPAEYGPQKSQRMASFLLYLTDVEEGGETMFPFENGLNMDGNYGYEDCIGLKVKPRQGDGLLFYSLLTNGTIDPTSLHGSCPVIKGEKWVATKWIRDQEQDD

SEQ ID NO: 13211 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQWVSFFAFKPPGCEESGKA

SEQ ID NO: 13212 - protein, 490 aa, Aspergillus niger
MVGIGPKRPPSRKGSMADVPQNLLQQIKDFEDQFTVDRSKLKQIVNHFVKELEKGLSVEGGNIPMNVTWVLGFPDGDEQGTFLALDMGGTNLRVCEITLTQEKGAFDITQSKYRMPEELKTGTAEELWEYIADCLQQFIESHHENEKISKLPLGFTFSYPATQDYIDHGVLQRWTKGFDIDGVEGHDVVPPLEAILQKRGLPIKVAALINDTTGTLIASSYTDSDMKIGCIFGTGVNAAYMENAGSIPKLAHMNLPADMPVAINCEYGAFDNEHIVLPLTKYDHIIDRDSPRPGQQAFEKMTAGLYLGEIFRLALMDLVENRPGLIFNGQDTTKLRKPYILDASFLAAIEEDPYENLEETEELMERELNIKATPAELEMIRRLAELIGTRAARLSACGVAAICTKKKIDSCHVGADGSVFTKYPHFKARGAKALREILDWAPEEQDKVTIMAAEDGSGVGAALIAALTLKRVKAGNLAGIRNMADMKTLL

SEQ ID NO: 13213 - protein, 601 aa, Caulobacter vibrioides
MTAHQTIESQAPADTADRAMTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 13214 - protein, 583 aa, Microbulbifer degradans 2-40
MMEAEHTSMTIPYLYETIAFLLTVVIVVPLFKRIKMSPILGYLAVGAIIGPYGAAVIHDANAVQHFAELGVIILLFTIGLELSFARLKSFSKLIFGLGAAQVLVSASIISGLAFWWGNTIEAAVIIGLCLALSSTAMVMQILHERSESATTYGRASFAILLFQDLAVVPILILLTILGDTSSGDSSLWLTVGSALLKAAITIGFIIFVGRFLLSFLFRHVARLRNIDVFTALMLLVILATSVITGLAGLSMALGAFLAGLLLAETEFRHQIESEIAPFKGLFLGLFFMGVGMNLDLVMAFEYGVWVVLSVVGLLALKATIATLFARLFGLSWQDALRTGLIVSEAGEFAFVVIGQATLSYQLIEPNIGQFMVVVAGLSMIFTPFLAMFGKWLADKYNLSQTPNAAPDALHDHIIIAGFGRVGQAVAHILTQQSIPYIALDTNADEVRRLQKQGAHIFLGDASKQEVLHMASVDNASVLLVTMDDSHASIRTTHGARQHHPELKIVVRSKDEQHSTALLHAGANQVVPETLEASLQLCAHTLQASGMSREEATACVEIERSEAYSRLLHEAKAIGNQNPACDKP

SEQ ID NO: 13215 - protein, 240 aa, Glycine max
MDFLVGPTFTIDVASSPPPYDADLPGVATAADRPYGLFSGHSSDSESSIGTPDDSDDDENDPDEDEDKEEEEEEEVHSKLKGLASLDSLEDSLPIERGLSNHFMGKSKSFTDLSQVNTLNTVKELQKQENPFNKRRRVQIATKLTRKSSFYAWSNPKSMPLLPVHEDEDNFLEEEEKPKKVSPSSSSSYSSEENKQDHVLVPKSYVDHMRARFGSFKSRSLSDLKEHDEEQEQEDDDDDA

SEQ ID NO: 13216 - protein, 188 aa, Streptococcus agalactiae 2603V/R
MLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 13217 - protein, 363 aa, Pseudomonas fluorescens
MKFSNFFRNSQLFSPQSASVGSGSQGASRVVYLNFNESPFGPLPPALDAARDSLPGCGRYGFGAIDQLHQALALELAVPADHLTLYPGSNRALHYAAATFTGPGRSLVVATPGYPICELAARRAGADVHKVPLRKDGAHDLARMCAVEDAGLIYLCNPNNPTGTITPHNAILQALAQKPGDAVLLVDEAYLQFCDEPSMLPWIEQRADLIVLRTFSKIYGLAGLRIGMAMAQPQTLQRITTLPADDVSITAAQAALASLGHGHQVAQRKQAIIRARNETIDWLQSRDIPCTRSQSSCFMMKVGEQAPQIIQTLADNGVHIGRTWPEAPEWVRVTVGSLEEMEVFKSVMSLTVCAHHHGLFYPI

SEQ ID NO: 13218 - protein, 188 aa, Burkholderia fungorum
MSNALPSAPLDAADYIKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGFEGH

SEQ ID NO: 13219 - protein, 749 aa, Thermosynechococcus elongatus BP-1
MTEDFRLVIDLSVVLGAAAVGGLLAALLRQPILLGYLLAGMLVGPTGLGLLKEVPQVEGLAQLGVAFLLFALGVSFSLGEIRKVQGVSLGGSALQILLTIAVTTLIAVGVGWVSSPNQGIFLGAVLSLSSTAVVLRSLMDRNELESIQGQIMLGILVVQDLAVGLMIAVLPALNKPPEELGLALGQAVLTIALIALGAIAAGMWLLPPLLRLLAKTESREIFLLGVVALCLGIALLTQYLGLSIEIGAFIAGLMISEVEYADQTLDYVESIRDIFTTLFFASIGMLIDPVFLWEHLDRIIELVSLVILGKFLITTPIVKFFGYSWKTSLLVGIGLAQIGEFSFVLLTAGRGLGLVSQQVYLLTLGTTAVTLLVTPFLLKLVPVLLELPLLRRLLKEDEILDMDLTGLPKRNHVIVCGYGRVGKSVVKLLQKQNYPVLVIEQSETVINEVRDAQLPYIYGNAASQTILAKAGVDQALGMAIALSDSMSTRLCLKRALEFAPELDVIVRANSDRDIELLYQLGAREVVQPEFEASLELAAHLFFSLGMGERHIQQQVQQVRDSHYANLRGDALPEGTARLLRQAAQDMNSRWLSVPEDSPIRGMSLAEIQLRQLTGVTLLAIVRADGTEVDYPSGQTRLQGGDRLLIVGEPAEFEACEALIHGRVSVPQGETFFLWILLPQEIGEKHCTIADLHLPETVTIRALRREGTLLSEPSSDCPLMAGDRLLLTGPMDALRRIGDQLQARSTPLPP

SEQ ID NO: 13220 - protein, 340 aa, Helicobacter pylori J99
MPNLENLDWKNLGFSYIKTDFRFIATYKNGSWSQGELVSENALQLSEGSPVLHYGQACFEGLKAYRSQKGKALLFRPLENAKRLQTSCERLLMPKVSEELFLKACAEVIKANQKWLAPYKSGASLYLRPFVIGVGDNLGVKPASEYLFIVFCAPVGAYFKGGIEKGGARFITTAFDRAAPKGTGGVKVGGNYAASLLAHKIATEQGYDDCIYLDPTTHTKIEEVGAANFFGITHDDAFITPHSPSILPSVTRKSLMVLAKEHLKLKVEEREILIDELGAFKEAGACGTAAIITPIKEIAHNNKSYSFEAPGNITKQLYDLLLSIQQGEQEAPKDWIFEVG

SEQ ID NO: 13221 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 13222 - protein, 113 aa, Bacillus anthracis str. A2012
MPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAASHI

SEQ ID NO: 13223 - protein, 246 aa, Zea mays
VPRGRPGPGLQEKVQKYEATFPEWNQENAKMLPWSNMYFRSFWKNAQSKGQISGDSPPDPSHFMRNGSSPGSNFTGKLDDNHNIVTSAAASGAQDQVETDHMASGCYRSAETTANFTNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 13224 - protein, 479 aa, Pseudomonas fluorescens PfO-1
MTKRYDNYINGEWVAGNDYSANINPSELSDTIGDYAKADLAQVNAAIDAARAAFPAWSTSGIQARHDSLDKVGTEILARREELGTLLAREEGKTLPEAIGEVTRAGNIFKFFAGECLRLSGDYVPSVRPGVNVEVTREALGVVGLITPWNFPIAIPSWKIAPALAYGNCVVLKPADLVPGCAWALAEIISRAGFPAGVFNLVMGSGRVVGEALVNSPKVDGISFTGSVGVGRQIAVNCVSRQAKVQLEMGGKNPQIILDDADLKQAVELSVQSAFYSTGQRCTASSRLIVTAGIHDKFVEAMAERMKSIKVGHALKAGTDIGPVVSQAQLEQDMKYIDIGQSEGARLVSGGGLVTCDTEGYFLAPTLFADSEASMRISREEIFGPVANIVRVADYEAALAMANDTEFGLSAGIATTSLKYANHFKRHSQAGMVMVNLPTAGVDYHVPFGGRKGSSYGSREQGRYAQEFYTVVKTSYIGS

SEQ ID NO: 13225 - protein, 318 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSKNDVRYR

SEQ ID NO: 13226 - protein, 362 aa, Saccharomyces cerevisiae
MRSLNTLLLSLFVAMSSGAPLLKIREEKNSPLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 13227 - protein, 160 aa, Oryza sativa
GTLALEDALSTGSPIRTEVDQLRKSLEGIDKDSLSVLEYGSDTPMDLKQKFNSLKETVRHFSLIPAGGGGMLTHAVAHVASSIKIKEDQSGDGIESLLNRVENLIIHGDLSAAAEALERGLQGSEAAEIASEWVKQARKRAIAEQTLTLLHSYASSITFS

SEQ ID NO: 13228 - protein, 793 aa, Zea mays
MAEKKRGAGTRKDEVVTREYTINLHKRLHGCTFKKKAAISASDISESFDNFPYYLSENTKNVLLSSSYVNLCCKESTKWTKDISSLCKRVLLSGPPGSEIYQELLVKALTKSFGAKLLVIDYSLLSGGQPSKSKESKPYKKGDRVRYIGPIQSSGFMFEGQRAPDYGSQGEVRLTFAENGSSKVGVRFDKQIPGGIDLGGSCELDHGLFCSVDSLCLDGPGWEDRAKHSFDVVFEFASEESQQVPVILFLKDVEKICGNNYTYHGLKNKLESFPAGVFIVGSQIQTDARKDKSNNGSPWLKFSYSQAAILDLAFQDSFGRVGEKNKEALKMSKHITKLFPNKVTIESPEDETELSQWKQLLGRDIEILKAKANFLKIQSFLTRHGMECTDLESVVCVKDRNLTSECVDKIVGYALSYQLKDHPIQTPGKDARVVLSGVSLKYGIDLLESIQSGPKKKSTKKSLKDVVTENEFEKRLLLDVIPPDEIGVTFEDIGALENVKETLQELVMLPLQRPELFSKGQLMKPCKGILLFGPPGTGKTMLAKAVATEAGANFINISMSSIASKWFGEGEKYVKAVFSLASKISPSVIFVDEVDGMLGRRENPGEHEAMRKMKNEFMVNWDGLRTKDKERVLVLAATNRPFDLDEAVVRRLPRRLMVNLPDAPNRKKILSVILAKEDLADDVDLEALANLTDGYSGSDLKNLCITAAHRPIREILEREKKERTLAEAENRPAPPQCCSGDVRSLKFSDFKHAHEQVCASISSDSKNMNELVQWNDLYGEGGSRHKTPLSYFM

SEQ ID NO: 13229 - protein, 419 aa, Zea mays
  unsure (1)..(419): unsure at all Xaa locations
MAARAADENRRPGVGRPAPCVRDMGSRRALTDIKNLVGVAPNPCAVAKKPVLQKSRRDEKKTALPSSRPMTRKFVASLASKEQPECQPTRADQRKEAIGDGTVDIDVELDEPVEDSDSDIDMGDETENKDIMNQDESLMDIDSADSGNPLAATEYVEELYKFYRENEAKSCVNPDYMSSQQDINSKMRAILIDWLIEVHYKFELMDETLFLTVNVIDRFLEKEVVPRKKLQLVGXTALLLCVXYHEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 13230 - protein, 549 aa, Oryza sativa (japonica cultivar-group)
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 13231 - protein, 259 aa, Bradyrhizobium japonicum USDA 110
MTERVTLITGASAGIGTELARVFAANGHRLALTARRADRLEALANELAAKGGKKPIVIACDLQEADAGEKIAAALAAEDVELDHLVNNAGFGVFGDAIECDRDEQVGIVDVNVRALTDLSLRFADQLIRNKGGLLNVGSVAGFLPGPGMAVYYASKAYVISLTEALRAELAPRGVRVTVLCPGPVPTEFQARAGVGSGHNTALLNVPASDVAREAYRGLMANKRAVLPGLGIKIVPFALRFFPRGFILSATSRFQRQRR

SEQ ID NO: 13232 - protein, 320 aa, Zea mays
MGILALITGKAGASGFGSASTAEHVTDGADASRLTVAITGGASGIGLETSRVFALRGAHVVIAARNTEAASEARKTIMEKNPTARIDVLKLDLSSLKSVRAFVDQFNSMKLPLNILINNAGVMFCPFQLSKDGVEMQFATNHLGHFLLTNLLLDTMKATAKSTGIEGRIVNLSSVAHHHTYPKGIDFDNLNDEKIYNDKMAYGQSKLANLLHAKELSRRLKEEGENITVNSVHPGLIMTNLMRPSFVLMKVLQVATYILWKNVPQGAATTCYVGLSPQLKGVTGKYFADCNVEKTSKLARNEELAKQLWDFSEELIKFAK

SEQ ID NO: 13233 - protein, 336 aa, Pseudomonas syringae pv. syringae B728a
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 13234 - protein, 248 aa, Eremothecium gossypii
MARTFFVGGNFKLNGSKQSIKEIVERLNTADLADNVEVVICPPATYLDHAVSLVSHPQVTVGAQNAYTKASGAYTGENSVDQIKDVGAKWVILGHSERRTYFNEDDEQVAEKTAFALERGVSVILCIGETLDEKKAGVTLDVVKRQLTPVLEKVKDWTNVVIAYEPVWAIGTGLAATAEDAQDIHAAIRDFLAERTSRDVADAVRILFGGSANGANAASFRDKADVDGFLVGGASLKPEFVDIINSRR

SEQ ID NO: 13235 - protein, 133 aa, Triticum aestivum
  unsure (1)..(133): unsure at all Xaa locations
MAPTVMASSATSVAPFQGLKSTAGLPVSRRSSSAGLGSVSNGGRIRCMQVWPIEGIKNSETLSYLPPSPXGGLXLKQVDYLIXRSNWVPCLXFNKLVPFPXRXHSPGYMAILAWNCYFGSTKVSVRRYLSVTA

SEQ ID NO: 13236 - protein, 140 aa, Salmonella enterica
KSDVYCQTGVHCQTNLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13237 - protein, 887 aa, GIBBERELLA ZEAE PH-1
MATEQQRLPTRERRPSTSAPIVDIQGAVGPTGISRPKHTRTATGFGPSEIKNFEASIPEPQREAWKRNQSRGFTGKDGFEQEVVRHVETTLARSVLNCDENAAYAATSLAFRDRLILDWNRTQQRQTYRDSKRVYYFSLEFLMGRALDNAMLNVGQKDIAKAGLSELGFRIEDIITQENDAALGNGGLGRLAACFLDSLASLNYPAWGYGLRYRYGIFKQEIVDGYQVEVPDYWLDFNPWEFPRHDVVVDEQIQFFGHVRKTTDSNGKSVAIWEGGEIVQAVAYDVPIPGYDTPTTNNLRLWSSKASGGEFDFQKFNNGDYESSVADQQRAETISAVLYPNDNLDRGKELRLKQQYFWVAASLYDIVRRFKKSSRPWREFPDQVAIQLNDTHPTLAIVELQRILIDIEHLEWDLAWDIVVKTFSYTNHTVLPEALEKWPVGLIQHLLPRHLQIIYDINLFFLQKVEKAFPNDRDILSRVSIIEESQTKMVRMAFLAIVGSHKVNGVAELHSDLIKTTIFKDFVEIYGPDKFINVTNGITPRRWLHQANPRLSELIASKVGGNGFLKDLTNLNQLEKYAEDKEFRKEWSEIKYANKVRLAKLIKSLVGVTVNPSALFDVQVKRIHEYKRQQLNIFGVIHRYLYLKSLTPEERKKVVPRVSIFGGKAAPGYWMAKQIIHLVNAVGSVVNNDEDIGDLLKVIFLPDYNVSKAEIITPASDLSEHISTAGTEASGTSNMKFVLNGGLIIGTCDGANIEITREIGENNIFLFGNLAEDVEDLRHNHQYGSHEIDPDLQKVFAEIEKGTFGSVHDFSALVAAVRDHGDYYLVSDDFHSYNETHKLVDEAYQNQEEWIKKTITSVSRMGFFSSDRCIDEYAESIWNTEPLVIHD

SEQ ID NO: 13238 - protein, 549 aa, Xylella fastidiosa Temecula1
MVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAESMQASGILAAVAAGITMSYVELSGNAQATIRVQRWAVWETVQFTFNGIIFVLLGEQLPGILDDLVHSAQQAGYMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 13239 - protein, 282 aa, Allium cepa
  unsure (1)..(282): unsure at all Xaa locations
MAAARRIGSTIFSRYATASPRSSQLCRAASRIQNFGSTAAAVEEQPITPPVKVEYTQLLINGKYVDSASGKTFPSLDPRTGEVIAHVSEGDAEDIDRAVAAARKAFDEGPWLKMTAYERSNILLRFADLIEKHNDHIAALETWDNGKPYEQAALVEIPMLVRLMRYYAGWTDKIHGLIXPADGPHHVQVLYEPIGVAGQIIPWNFPLLMFAWKVGPALATGNTVVLKTAEQTPLSALYVAKLFHEAGGPDGVLNVISGFGPTAGAALASHMDVDKLAFTGST

SEQ ID NO: 13240 - protein, 441 aa, Dumontia incrassata
  unsure (1)..(441): unsure at all Xaa locations
PQPGVDPVEASAAVAGESSTATWTVVWTDLLTACDLYRAKAYKVDAVPNTSDQFFAYIAYDIXXXXXXXXXXXXXXXXXNVFGFKAVKALRLEDMRLPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMXXMYERAEFAKQLGSVIIMIDLVIGYTAIQTMAIWSRKNDMILHLHRAGNSTYSRQKIHGMNFRVICKWMRMAGVDHIHAGTVVGKLEGDPLMIQGFYNTLLQPYLPVNLPQGIFFEQDWASLRKVTPVASGGIHCGQMHQLLDYLGVDVVLQFGGGTIGHPDGIQAGATANRVALESMVIARXXXXXXXXEGPQILQDAAKTCGPLQTALDLWKDISFNYTSTDTPDFVETPTANV

SEQ ID NO: 13241 - protein, 476 aa, Glycine max
  unsure (1)..(476): unsure at all Xaa locations
MPEETTSIDYVMEAASGPHFSGLRLDGRMPSSATAAAASSSADSTLTPDFLPNQPFVIGVSGGTASGKTTVCDMIIQQLHDHRVVLVNQDSFYRGLNPEELERVHEYNFDHPDAFDTEQLLECTMKLISGQGVHVPIYDFKKHQRSSDSFRQVNASDVIILEGILVFHDQRVRDLMNMKIFVDTDADVRLARRIRRDTMERGRDINSVLEQYAKFVKPAFDDFVLPSKKYADVIIPRGGDNHVAIDLIVQHIRTKLGQHDLCKIYPNAYVIQSTFQIRGMHTLIRDRDISKHDFVFYSDRLIRLVVEHGLGHLPFTEKQVVTPTGSVYTGVDFCKKLCGVSIVRSGESMENALRACCKGIKIGKILIHRDGDNGKQLIYEKLPKDISERHVLLLDPVLATGNSANQAIELLIQKGVPESHIIFLNLISAPEGIHCVCKRFPSLKIVTSEXDIEINEEYRVIPGLGEFGDRYFGTDD

SEQ ID NO: 13242 - protein, 174 aa, Photobacterium profundum
MIRNSIKSISDYPKPGILFRDVTSLMEDPEAYRATMQVLIERYSNTGITKVIGTEARGFLFGAPLALELGVGFVPVRKPGKLPREVISESYELEYGKDILEIHVDAIVEGDKVLLVDDLLATGGTIEATTKLARRLGGVVEDAAFVINLPDIGGAERLKGIGLNVFSICDFDGH

SEQ ID NO: 13243 - protein, 337 aa, Glycine max
IRLEIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 13244 - protein, 433 aa, Xanthomonas campestris pv. campestris str. ATCC 33913
MSSQGNESPALVRAVSRWQIVGLSINDVIGSGIYLLPAATAALLGPMSLWAVMLAGLAVALLVLCYAQAASYFDTPGGSYLYTREAFGPFTGFQIGWMIWLTRISSAAALSNGLADAVARFWPAAGSDGWERLLVVVGSLGLLTAINVIGVKSAARTGVALVIGKLVPLLLFVAIGLFYVDWSWAFAGSTPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALAQDGYGPALLARVHPRFHTPAAAVLTQGVLSLALALSGSFTQLALLSMVTRLFAYIGTAAAVIVLARRYRARTDALRLPGGPLIPIAALLLSLGLLASASWQNLAAAGLALLVGCVFYLFPRKPA

SEQ ID NO: 13245 - protein, 84 aa, Triticum aestivum
  unsure (1)..(84): unsure at all Xaa locations
RLGEXLXPQDEXVFHKTVAELLXPRVICXWXPRKSPXPGRGEPLWXSXYLRDXWXXTDLPGDQSTATSSSNKPPRERPYPVGKT

SEQ ID NO: 13246 - protein, 169 aa, Glycine max
MSMSLSLLRIFSSPHLSTSLFFPTPTLSSLCPSFLSKLPNAPSPLIVLCHRDASASKQGHLGVPEGAERDSGSEEDDDAVEQPMRASYDDDEDEEEGALSSLVFPERWDVLGLGQAMVDFSGMVDDNFLKNLGLEKGTPKVVNHEERGRVLQAMDGCSYKAAAGGSLSK

SEQ ID NO: 13247 - protein, 170 aa, Helicobacter pylori
GSGMHTHVSVWENNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 13248 - protein, 162 aa, Triticum aestivum
MEGRMFGLETPLMTALQHLLDVPDGESGGAGNAGGEKQGPTRAYVRDARAMAATPADVKELPGAYAFVVDMPGLGSGDIKVQVEDERVLVISGERRREEKEDAKYLRMERRMGKLMRKFVLPENADMEKISAVCRDGVLTVSVEKLPPPEPKKPKTIQVQVA

SEQ ID NO: 13249 - protein, 360 aa, Oryza sativa (japonica cultivar-group)
MLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 13250 - protein, 869 aa, Cellvibrio japonicus
MKDDFPQRLLRVSAASLLVLAALAGCYSRAPSTTDSTTTVSADTVTTQATEKVEWPVLNSAIKKDPAVEARVDDLLARMTLEEKIGQLVQPEIRHVTPEDIKQYHVGSVLNGGGSTPGANKYASLEDWCKLADSFYYASVDKSDGRIGIPVIWGTDAVHGLGNVIGATLFPHNIGLGATNNPELLKQIGWATAREIAATGLDWYFSPTVAVARDDRWGRTYESWSEDPQIVHAFAGKMVEGLQGTGGSDRLFTHEHVIATAKHFIGDGGTLNGVDRGETQGDEKVLRDIHGAGYFSAIESGVQVVMASFTSWEGTRMHGHKYLLTDVLKDLSGFDGLVVGDWSGHSFIPGCTALNCPQSLMAGLDIYMVPEPDWEELYKNLLAQAKTGELPMARVDDAVRAILRVKIRAGLFEKGAPSTRPLAGKKDVLGAPEHREVARQAVRESLVLLKNKNNLLPLARQQTVLVTGDGADNSGKQSGGWSVSWQGTGNTNADFPGATSIYAGINAVVEQAGGKTLLSDDGSFSEKPDVAIVVFGEDPYAEMQGDVGNMAYKPRDTSDWELLKKLRSQGIPVVSLFISGRPLWVNREINASDAFVAVWLPGTEGQGIADVIFRNAQGEINYDVKGRLSFSWPKRPEQTPLNRGDANYDPLFPYGYGLSYGDKDTLGDNLSEEGIQLAEALDVLDLFNRRPIEPWQLEIIGYQNDRVPMASSTVTASSLKIQAVDRNEQEDARRVQWNGSGPGQVALSVGDRQDFIGYVKSDSALVFDIKVNAAPTVTTYLRLGCGSYCASDIDLTEKLKGFAGQDVQTVTVPLHCYPNSGANFGVTQPPEEFWTQVLQPFSLLTSGTLDVTFAQVRVVKGAGKDVACP

SEQ ID NO: 13251 - protein, 200 aa, Zea mays; identical to SEQ ID NO: 663

SEQ ID NO: 13252 - protein, 61 aa, Daucus carota
DPLKAYLARYRELEGDTKGSARGEGSAKKDQVGAHISNQQYAHQGSYSQGMSYVKLTHLLC

SEQ ID NO: 13253 - protein, 381 aa, Pseudomonas fluorescens PfO-1
MRLADSSYLWPMALECFMVDRSSSPGGPQRPPLSAASLVLRLGGIAVVVAALAGAFAYVHGSFDPQRLTPKALVDVLEKNNGVHPGFRRNHAKGVCVIGHFESSGEARAYSVAQVFNEPRTRVVGRFALPAGSPYAPDSAVPIRSLALRFTQANGQQWRTGMNSMPVFPVGTPEAFYQLQQAQSPDPATGKPDPTKVPAFFAAHPEAVPFLTWIKTAKPSASYATETYNSVNAFYLVDASGKKQAVRWSMTPLAQDAAGATAPEGSDFLEKDLVQRLAEGPLRFQLNITLANADDPVNDASKTWPAGRKVLNAGTLVLEKTQPQLSGECRDINYDPLVLPAGIQGSDDPLLAARSAGYADSYLRRTSEVSQLPTGKKEARP

SEQ ID NO: 13254 - protein, 250 aa, Oryza sativa
  unsure (1)..(250): unsure at all Xaa locations
LVVALLLSFSFSLLKRLVGMFEYPSLEAATEKFSESNMLGVGGFGRVYKAAFDAGVTAAVKRLDGGGPDCEKEFENELDLLGRIRHPNIVSLLGFCIHEGNHYIVYELMEKGSLETQLHGSSHGSTLSWHIRMKIALDTARGLEYLHEHCSPXRVIHRDLKSSNILLDSDFNAKIADFGLAVSSGSVNKGSVKLAGTLGYVAPEYLLDGKLTEKSDVYAFGVVLLELLMGRKPVEKMSPSQCQSIVTWAM

SEQ ID NO: 13255 - protein, 270 aa, Escherichia coli
LLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAF

SEQ ID NO: 13256 - protein, 232 aa, Zea mays
  unsure (1)..(232): unsure at all Xaa locations
IHRGRTGRPRLPLFLCSPVRPLPPLVGVVAAARIIVRASLPRPPTAPPQERATQRFDSGRREWRRRRPSPPPTSPASPLPHRPRSTTTRTTSSASAAPAAXAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALEPNLKVM

SEQ ID NO: 13257 - protein, 381 aa, Oryza sativa
  unsure (1)..(381): unsure at all Xaa locations
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNVANSRAXGTPISPPTGVIVPSHTGVSTELLIKDERELKREKRKQSNRESXARRSRLRKQAETEDLATQVESLAAEPTSLRSEISRLSESSEKLRLENSALMGKLKDPAASTQAETSLQKTITRASPRVVEFFLSMIDNTNKTSVRHTEHAEPKLRQLLGSGPATDVVAAS

SEQ ID NO: 13258 - protein, 492 aa, ASPERGILLUS NIDULANS FGSC A4
MSLASLKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHIKDAQEKGASLLLGGSPCQPNNLPGYFLEPTVLGKMSTEALTTREEVFAPVVALYPFKTEEEVLAKANDCDVGLGSYVITESMPRMWRVAESLEVGMVGINMGTLSAAESPFGGVKESGYGREGGRQGIEEYMTVKSILMNVAA

SEQ ID NO: 13259 - protein, 414 aa, Chondrus crispus
MAFVAPVATVRATTKSSVCQVQGRSTFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 13260 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEDEMKGVLGYTEDDVVSTDFNGEVCTSVFDAKAGIALNDNFVKLVSWYDN

SEQ ID NO: 13261 - protein, 85 aa, Triticum aestivum
  unsure (1)..(85): unsure at all Xaa locations
LHLXSSIDVXXKYPVAECDIWFIKXXCDFHFNQLAIGNXEGKXYMXXVQMSPVVLITRCVDYSHKKVNWWWQVHFYNTCYIWLLR

SEQ ID NO: 13262 - protein, 534 aa, Neurospora crassa
MADEKHSAVAPAVDATHNEASEVPSKPGSHQDITIPPPRPPGWMYKGFKVFGHELWYASPLFQLLLVAVVCFMCPGMFNALSGLGGGGQVDHTAQDDANTALYSTFAVVAFFSGSIANKLGVRLTLSFGGLGYVIYIASFFSYNHNQNHGFVVFAGAFLGVCAGLLWTAQGTIMMSYPTEDMKGRYISWFWIIFNLGAVIGSLIPLGQNINKVAGPVTDGTYVGFLVLTLIGAFLALMICDVDKVVREDGSRVIMMKNPSWITEFKGLFETITSEPWVVLLFPMFFASNTFYTYQSNDMNGSQFNTRTKALNNTLYWLAQIFGAIIVGYALDFAGARRSIRAKGSFVMLIVLTMAIWGGGYAWQKDQPTREETAEEGFVTVDWTDGAKKYVGPMFLYMFYGFFDAAWQTCIYWYMGALSNSGRKAANLAGFYKGLQSAGAAVFWRLDGLKKPFDHIFGATWGLLGGALLIAAPVIWMKIQDTVALEEDLRFSDETAADVVTGAEGAVAAGQAAQPETVAVGAHGGGSETAKAVV

SEQ ID NO: 13263 - protein, 744 aa, Hypocrea jecorina
MRYRTAAALALATGPFARADSHSTSGASAEAVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 13264 - protein, 286 aa, Salmonella typhimurium LT2
MPLVNGRILLNCIQEKHVLAGAFNTTNLETTISILNAIERSGLPNFIQIAPTNAQLSGYDYIYEIVKRHADKMDIPVSLHLDHGKTLEDVKQAVRAGFTSVMIDGAALPLEENIAFTREAVDFCKSFGVPVEAELGAILGKEDDHVSEADCKTEPEKVQRFVEETGCDMLAVSIGNVHGLEDIPRIDIPLLQRIASVSPVPLVIHGGSGIDADILRSFVNYKVAKVNIASDLRKAFITTVGKAWVNNNNEANLARVMANAKQAVEDDVYSKIKMMNKNHSAFRKVS

SEQ ID NO: 13265 - protein, 557 aa, Suaeda maritima subsp. salsa
MWSQLSSFFASKMDMVSTSDHASVVSMNLFVALLCGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAYRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLLMVGRALLFSLVFLMNLSKKSNSEKVTFNQQIVIWWAGLMRGAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSTTNLSQRT

SEQ ID NO: 13266 - protein, 284 aa, Griffithsia japonica
  unsure (1)..(284): unsure at all Xaa locations
ARGVGILADDTDPMVSVMKVDKAPLESYADIGGLETQIQEIKEAVELPLTHPELYEDIGIKPPKGVILYGEPGTGKTLLAKAVANSTSATFLRVVGSELIQKYLGDGPKLVRELFRVAEDMAPSIVFIDEIDAVGTKRYDTTSGGEREIQRTMLELLNQLDGFDSRGDVKVLLATNRIETLDPALLRPGRIDRKIEFPLPDEKTKRRXFSIHTGRMTLAGDVNXEEFVMNKDELSGADIKAICTEAGLMALRERRMKVMHADFKKARENVLYKKNQGVPEGLYL

SEQ ID NO: 13267 - protein, 243 aa, Houttuynia cordata
MGRGRVELKRIENKINRQVTFAKRRNGLMKKAFELSVLCDAEVALIVFSSRGKLYEFCSSSGMMKTIERYQKCNYGAPEATVSTKEIQSSYQEYMKLKARVESLQRSQRNLLGEDLGPLTGKELEQLERQLDMSLKQIRSTRTQCMLDQLSDLQRREQMLSEANKALRRRLLQLDDGSQTNPHHSWDPNAHGVGYSRHPGQPQGEVIFDPLDCEPTLHIGYQPDQITIAAPGPNGNYMQGWLP

SEQ ID NO: 13268 - protein, 211 aa, SYNECHOCOCCUS SP. WH 8102
MSELQRLKGLLPPEMQSWVFVETAAAVDPPLITLEEIGRDEVEIQVDLDAWDSMALDHRNLLFWHEVGRIQNDTIPRDGWEMAALAIGLGGAIGELWVQDGLLLMMALGLSGFAGYRLYLKNNSEKRLQDAISADERAIDLACRFGYSVPNAYRSLGGALKELVEQTRKKKRRSYYEDRLEALRKSASKARAEMAQQEGSRSSVTSENVYG

SEQ ID NO: 13269 - protein, 228 aa, Buchnera aphidicola str. APS (Acyrthosiphon pisum)
MNKFFLAPSILSADFARLGEDIKKVIDAGSDLIHFDVMDNHYVPNLSMGPMILESLRNYNITAPIDVHLMVKPVDNLIPQFAKAGATFITFHPEATLHIERTLNLIKENGCKAGLAFNPATPLNFLDYILEKLDLILLMSVNPGFGNQSFLPSTFNKLREVRKIIDANFSDILLEVDGGVKLDNIADIACAGANVFVMGSGLFKYSNYKLVIEKIRKKLEYAHSRSIH

SEQ ID NO: 13270 - protein, 198 aa, Streptococcus pneumoniae
GIEDILVVTGKSKRSIEDHFDSNFELEYNLKEKGKTDLLKLVDEATGMRLHFIRQTHPRGLGDAILQAKAFVGNEPFVVMLGDDLMDITDEKAVPLTKQLMNDYEKTHASTIAVMPVPHEDVSSYGVIAPQDEGSNGLYSVETFVEKPAPEETPSDLAIIGRYLLTPEIFEILEKQAPGAGNEIQLTDAIDTLNKTQR

SEQ ID NO: 13271 - protein, 406 aa, Streptomyces avermitilis MA-4680
MTVESTAARKPRRSAGTKSAAAKRTSPGAKKSPSTTGAEHELIQLLTPDGRRVKNPEYDAYVADITPEELRGLYRDMVLSRRFDAEATSLQRQGELGLWASMLGQEAAQIGSGRATRDDDYVFPTYREHGVAWCRGVDPTNLLGMFRGVNNGGWDPNSNNFHLYTIVIGSQTLHATGYAMGIAKDGADSAVIAYFGDGASSQGDVAESFTFSAVYNAPVVFFCQNNQWAISEPTEKQTRVPLYQRAQGYGFPGVRVDGNDVLACLAVTKWALERARRGEGPTLVEAFTYRMGAHTTSDDPTKYRADEEREAWEAKDPILRLRTYLEASNHADEGFFAELEVESEALGRRVREVVRAMPDPDHFAIFENVYADGHALVDEERAQFAAYQASFTTEPDGGSAAGQGGN

SEQ ID NO: 13272 - protein, 764 aa, Xylella fastidiosa Dixon
MSNDTFKQAAIDYHRTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVVTMAPDPVIFALANPIPEIMPEAVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKVGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQIAEATLQACYRLKLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 13273 - protein, 331 aa, Synechococcus sp. PCC 7942
MDASLLLRQITTGYWGSQALYVAAKLGIADQLVNGPRSCEDLAIVVGAKPEVLYRLLRALASLGIFTEVSDRQFALTPAAELLRSGTAGSLRNLVMMFGEEHYVAWGELLHSIQTGENAFEHHYGAPVFAYYAQHPASADIFNGAMSDMSRPDTAAVLSSYDFQGIRCLVDVGGGHGQLLSQILAAYPDLTGILYDQPAVVAGADSVLADVSDRCEVVGGDFFASVPAGGDAYLLKHIIHDWDDADSLKILANCRQVMQPGDRLLLLEQVVRAGNEPNLAKWLDLNMLVMTQGGRERTQAEFATLLADAGFQLSQIHGTASEVCIIEGRAI

SEQ ID NO: 13274 - protein, 517 aa, Schizosaccharomyces pombe
MLNEPNALLRRDANSTIATVTELFPNEYSNADIAYVLLSTVVVFTVTPGIALYYAGMVRKNSALSILTQSFLVTAVVFIQWYLFGYSLACSSGSSFYGTLWQGGMNHLWLEPYIPGSTIPAIVYFPFGGLFAVATAQLFAGAMAERGRLIPSLVISFLYITLVYCPQAYWTWAPNGWLYTLGALDFAGGGPVHISSGFAALAYSLCLGRRIVVDEPDRPDSIRSTDNADLPSSSQNNCKANWKRWFGFKSVSWKNSFGRGKIAHNPPHDAGMVYIGVVLIWFAWLCFNSGTLLTVNIRTAYIMTNTLISSSFGALTWAIIDYIRYRKFSTIGICEGAIAGLVGITPACGFVFPWGAAAGGIVPALVCNFLHDLNEWIGVDETLRVFNLHGIGGIVGSIVLGVVAHPDVAASDGATVIDGGWAVHHWKQMGYQFAGFTSVAAWSFVITAIICLLVDLVPGLHIRASFEEELRGMDFVELEEQLPGQTLESKPMIIYAQEMDEPVTQGSNIKQEKQDEF

SEQ ID NO: 13275 - protein, 341 aa, Chlamydomonas reinhardtii
MSGKIKIGINGFGRIGRLVMRATMLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 13276 - protein, 301 aa, Triticum aestivum
WRQDNAAGSGGGGVKDYVMEWIRSEIKKERPKSDWISGASTTTPTTSAEKKKPKRRAREWWREEYAEELTKKQKRQAIAKSKSDAGVMTGLQWWEKDCDLEEKGRSRWRMMKSWSRRSSNGNGNSTIDWWADGVRSSKDWASTEFVPKSGGAVSSTPSMRGTVCYVAPEYGGGGPLSEKCDMYCEKTTEGVLISGRRPLQVTASPMSEFEKASLISWARHLAHVGRLLDLVDSALLDVNRDQALLCITVALLCIQRSPTRRPSSEEALEMLSGEGEPPHLPVEFSPSPPGGFPLRSLTKGR

SEQ ID NO: 13277 - protein, 181 aa, Zea mays; identical to SEQ ID NO: 9493

SEQ ID NO: 13278 - protein, 199 aa, Oryza sativa
MGEEANCNVAMESAAPKENGHTTDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESRE

SEQ ID NO: 13279 - protein, 276 aa, Glycine max
SSVDKVFGLWTANTEGGSFLFVGLNDTMENLFACLDRNEVEIDPFTLYAIACVMENVPFINGSSHNTFVPWLIDLAIKSNRKIGGYDFKSGQTKMKSVLVDFLVGAGIKPTSIVSYNHLGNNDGMNLSVPQTFRSNEISKSNVVDDMVNSNAILYEPGEHPDHAVVIKNVPYVFYIKRAMDEYTSEIFMGGKNTIVLHNTWEDSLVAAPIILDLVLLAELSTRIEFKAENEGKFHSFHPDATILRYLTKAPLGPPGTPAVNGLTKKRAMLENNLEA

SEQ ID NO: 13280 - protein, 329 aa, Zea mays
  unsure (1)..(329): unsure at all Xaa locations
MSFGTVGMEEESGAAAAAAAAEEIRRLPAEVNWEMLDKSRFFVLGAALFSGVSAALYPAVVVKTHLQXPPPQAARATAAAILRRDGLRGFYRGLGASLGGTVPARALYMAALEATKSSVGSAAVRLGVSEPAASAAASAAAGVSAAVAAQVVWTPVDVISQRLMVQTPDACRYRGGADAFRKILLADGVRGLYRGFGLSILTYAPSNAVWWSTYAVAQRCLWRAVGTERSESCACLMAVQGASAAVAGGAAALVTMPLDTVKTRLQVMEADAARPTLASTVRGLLREGGWAACYRGLVPRWGSMSLSAATMVTTYEFLKRLSAKDGSLG

SEQ ID NO: 13281 - protein, 882 aa, Xylella fastidiosa 9a5c
MPLPIAAPPILASTLTLLLATTPTAAALTPEQHAAALVAKMTLQEKITQTMNAAPAIPRLGIPAYDWWSEGLHGIARNGYATVFPQAIGLAASWNTDLLQHVGTVTSTEARAKFNLAGGPGKDHPRYAGLTLWSPNINIFRDPRWGRGMETYGEDPYLTGQLAVSFIRGLQGNIPDHPRTIATPKHFAVHSGPEPGRHSFDVDVSAYDLEATYTPAFRAAIVDGHAGSVMCAYNALHGTPACASDWLLNTRLRNDWGFNGFVVSDCDAIDDMTRFHFFRQDNASASAAALKSGNDLNCGNTYRDLNQAIARGDIDEALLDQALIRLFAARQRLGTLQPREHDPYATIGIKHIDTPAHRALALQAAVQSLVLLKNSGNTLPLTPGTTLAVLGPDADSLTALEANYQGTSSTPVTPLTGLRTRFGAAKIHYAQGASLAPGVPGTIPETALRNHGHPGLKGEYFDTIDFAGPPHLVRQDRIIAFNWDHVAPAPGMNPHRYAVRWTGELLPPGPGTYTFAVHVARCFDCNGHDPVRLSIDDRQIIPDNATAAQATTAPQQTDNTHLEATLHFTDTRPHHIRLDMEHRGEDQGVRLEWLAPAAPQLAEAERAVAHADAIVAFVGLSPEVEGEELHIDTPGFSGGDRTTIDLPATQETLLQHVKTTGKPLIVVLMSGSAVALNWAQHHANAILAAWYPGQSGGTAIAQALAGDVNPGGRLPVTFYRSTQDLPPYISYDMTGRTYRYFKGQPLYPFGYGLSYTQFTYEAPQLSTATLKAGDTLTVTAHVRNTGTRAGDEVVQLYLEPPHSPQAPLRNLVGFKRVTLRPGESRLLTFTLDTRQLSSVQQTGQRSVEAGHYHLFVGGGQPNTGAPGGTAAFSIIGRALLPK

SEQ ID NO: 13282 - protein, 420 aa, Oryza sativa
MDRASENRRLAAVGKPVPGIGEMGNRRPLRDINNLVGAPSHPSAIAKKPMLEKSGKEEQKPALVVSHRPMLRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 13283 - protein, 534 aa, Oryza sativa
MDSARSWLQKLQPRDKDRGKPASPTAARKDGAAAMAEDGEEAISSTTATKVAAAKQFIENHYKDQMRSLEERKERRRMLESKLADPDVSEEEQNNILKDFENREREIMRSRRHKMGVDDFELLTIIGRGAFGEVRLCREKATSNVYAMKKLKKSEMLRRGQVEHVRAERNLLAEVDSAYIVKLYCSFQDEEFLYLVMEYLPGGDMMTLLMRKDTLTDDESRFYVAETILAIESIHKHNYIHRDIKPDNLLLDRTGHLKLSDFGLCKPLDSSSFPNLSEFDYAVGKNINPSMDGDKLLSSSAAPRRTQQEQLLHWQKNRRMLAYSTVGTPDYIAPEVLLKKGYGMECDWWSLGAIMYEMLVGYPPFYSEDPMSTCRKIVNWRSHLKFPEEAKLSPEAKDLISKLLCNADLRLGTKGAHEIKAHPWFKGLEWEKLYQMEAAFIPEVNDELDTQNFEKFEEVRSPMQTSSKAGPWRKMLSSKDTNFLNFTYKNLELSDDPEHPGIGSHLVDGHGAEQIERPEPAASTRYEAKMSECL

SEQ ID NO: 13284 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 13285 - protein, 829 aa, Desulfovibrio desulfuricans G20
MQQGGLMSRVCKMSKNVREVFRLDELKDDIRRNMVALLGNDPRSKRKFSYYNALAYSVRERLVDLWMRTQSDYYDSMAKRVYYLSMEFLPGRFLMNYLTNMGIVDECREIVAELGFSLEELEEEEWDAGLGNGGLGRLASCYLDSMVSQNIPGYGYGILYDYGIFYQSIVNGNQEERCDNWRRHGCPWEITRLDTLYEVKFYGRSETYYDSDGNVRFRWVDTENVMAMPCDILIPGYGCSHVSNMRLWTAQSSREFNLSDFNRGDYIGAMHGKVMSENITKVLYPNDQFLQGMELRLKQQYFLVSATFQDILRRYLKQHTSLAALPEAVAVQLNDTHPAIAIPELMRLLMDVYGMGWDVAWDICTRTFAYTNHTVLPEALETWPVDLLGRLLPRHMQIIYEINRRFLEGVAATFPGDTERLSRMSVIQEEGGQRVRMANLAIVGSHTVNGVAALHSNILQTGLFRDFHEYYPRKIRNVTNGVTPRRWLMQCNPALSRLITQSIGPEWCCNLEKLRELVPLAEDSAFRDAWARAKLENKRLLSRYVLRKVQMGINPNTLFDMQFKRMHEYKRQLLNVMHVISLFNRIKDNPSADITPRTVLFGGKAAPGYYQAKLIIRLINEVARVVNADADVAGRLRVAFLPNYCISQAEKVVPAADLSEQISTAGMEASGTGNMKFALNGALTIGTLDGANVEIMEEVGAENIFIFGLKAHEVAEKRRSGYNPREFYENDAELRRVMDMIGSGFFSPDERGLFSPVYDSLMHHGDYYMLMADYRPYMEAQAAVDALYLDQDQWVRKSILNAANMGKFSSDRSVMEYARGIWHVEPLGK

SEQ ID NO: 13286 - protein, 142 aa, Zea mays
MGCSFSGLNALYDTVGGRGGDVWVNDYHFRVLRRLGDAGPAGSSVFLVKEVVAAATASDGTAGSEPGASGIAGKKGIDPSHISADGTYALKKVLVQSDQHLELVQQEIRVSSQFSHPNLLPLLEHAIVAVKRKQSHLAFDGF

SEQ ID NO: 13287 - protein, 199 aa, Glycine max
MIYVAGGNSTDLYELDSAEVLDPLNGSWRPIANMGTNMASYDAAVLNGKLLVTEGWLWPFYVSPRGQVYDPRTNNWENMAVGLREGWTGSSVVVYGHLFVVSELERMKLKVYDPENDSWEAIEGPPLPEQICKPFAVNACDCHIYVVGRNLLVAVGHITRLNPKESCKEKWNFSVRWHVIDAPESLSDLTPSSSQVLFA

SEQ ID NO: 13288 - protein, 338 aa, Vibrio vulnificus CMCP6
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 13289 - protein, 237 aa, Glycine max
  unsure (1)..(237): unsure at all Xaa locations
PYGCEKTTEGYPKNEKLFLVCFSFAEGPLAWALIVWRCSLVFSSVDKIVSVLIHLLPELVFFTIRWWNPATFEAMRPAGMAGRSTWPYIEDKSYLWMWLFLVPLAVYILWQVLYFLIVNVLRQQRFLRDPEAMTSYRELSKKAQKANNIWWRLSGLLGDQNXLLMYIXLQGIFTVATPALTVPIFLSYELSVVFQLLKISASVWNGGSFLIDVMPRQVILKEKKKSEMQLVQNQKDQ

SEQ ID NO: 13290 - protein, 217 aa, Glycine max
MAAVGDEKEQEELIPGLPYEIAELCLLHVPYPYQALSRSVSSTWNRAITHPSFIFSKKTLSRPHLFVLAFHSQTGKIQWQALDPSSGRWFVLPQMPLQENSCPTEFACAALPHQGKLFVMAGGGGGSDTLVYRAATNQWALAAPMPGGRKRGFFAAEGVEGKIVAVGRSGTDIYDPESDTWREGKKQGGELKRYEVVAAGGKVYVSEGWWWPFMYRP

SEQ ID NO: 13291 - protein, 486 aa, Glycine max
  unsure (1)..(486): unsure at all Xaa locations
TKPKKDITQNATGPDETTSIDYVMEATSAPHFPGLRLDGXSRPPATAASSTPDSTLTLDSLPNQPFVIGVSGGTASGKTTVCEMMIQQLHDHRVVHVNQDTFYRGLNPEELERVHEKNFDHSDAFETKQFLECTTILISGQGVHIPKYASKKHQHSLDSFRQVNASVVTLLEGNLVFHDQRVRDLMKMQIFVDADADVRLARRIRRDTMERGRDINSVLEQYAKFVKPAFDDFVLPSKKYADVIIPRGGDNHVAIDLIVQHIRTKLGQHDLCKIYPNGYVIMSTYQIMVIHTWILDRDISEHYFEFYKHCLISLVVVDGLVHPPIPEXKVVTTPIFVGNQVDLCKKXYCVGFGRSSERKKNEFRACSQVIKIVKTLIPWAVNNXKXLINEKLPKDIAEHHVLLLHLVLATRNSARHVIKLIIKNGVLXSYIIFLNLISAPEGIHCVCKRFPSLKIVTSEIDIEINEEYRVIPGLGEFGDRYFGTDD

SEQ ID NO: 13292 - protein, 341 aa, Methanosarcina mazei Goe1
MDLLVIAIILAGLYMAWNIGANDLANAMGTSVGTGALTIKQVIIIAAVFEFLGAVVFGNRVTSTIAKGIVPIDMISSIHPDIVVLGMLASILAASFWVTLATFYNLPVSTSHSIVGSVLGFGLIAAYNGIISFSDIHWTVLLKIIASWFISPALGAILAFLIFSIIRSLYLHRASDMPAVEKKFLFLQIITGCYIAFAHGSNDVANAVGPLSAALNVLGVTGTGAPIWVLVMGGLGMVIGMATWGYKVVETIGSKITELTPTRGFSAQFATASVVLLHSYSSLPISTTHTLVGSVIGVGLAGGLAAVDLGVIWRIISSWIATVPIAALTSAIIFVGLEVIF

SEQ ID NO: 13293 - protein, 263 aa, Glycine max
MATFSKERENFVYVAKLAEQAERYDEMVDAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 13294 - protein, 147 aa, Triticum aestivum
  unsure (1)..(147): unsure at all Xaa locations
MAAAALRVQLEALLEXMFATGMVDEQFRQLQSLQEGGSASGFVAEVATLFIDDADRIIADIGSLLDQPVVDFDKVDAHVHQLKGSSSSVGAQKVKLACMHFRQFYEAKSKEGCLMALALVRSEFCDVRNKFQTMMQLEQQIEACSPK

SEQ ID NO: 13295 - protein, 835 aa, Clostridium thermocellum ATCC 27405
MLFKVQQEIYERMNRMKAVIMAGGEGTRLRPLTCNRPKPMVPVVNKPVMEHIIELLKKHGFTDIAVTLQYLPDMIKDYFGDGSDFGINLRYYVEDKPMGTAGSVKNAEEFLDDTFLVISGDALTDIDLGKAVEYHYSKGSMATLVLKKVDIPLEYGVVVTDENGRITRFLEKPSWGEVFSDTVNTGIYILSPEVLKYFNKNEMFDFSKDLFPMLLKENKPMYGYITDEYWCDIGDLMAYSKAHMDVLDGKVKINIPGNKIKDRVWVGEGTVIEENVVIEEPCVIGANTRIKKDSVIGSYSVLGDNNIIGERSGIKRSILWKNNVLETNTQLRGTVVCSKVNIKEGVFAFENSVIGDDTQIGKNAVIKPSIKIWPNKIVEGGTEVNSNLVWGSKFVRSIFGFRGVAGEINVDITPEYASKLGAAYGAIFKGKGKIGVSSDDSAAAKMLKMSFMSGLLSAGLKVLDFGVLHLPVARSAVRFYGADGGIHISTSSTNFGRLTVDFLDKNGSNIKREVERKIENAFQREDFSRCEGEAIKDVEVIPDYTKYYLRNIINNTRSKDFGYRIALNSLSGFILETVGNLLETFGCTVEKTSLDLRNAKTMRNGNKSAEMTYFTDMIKMGNYDLGVSIEDTSEKMMLVDNNGRIVSDDMFTALISLIVFKTVQGGTVVVPISTSSVVDKLAEQNNGKVIRTKTSPQDIMNKMLGNETKENVYEQFTLHFDAIAGLVKILDFMKSENYSLSDLVNMIPDFYVSEKEVECSWNVKGKVIRQIIQENEGQSIETLEGVKIFKDGGWVLVLPDAEQPVCRIKSESYSAEFAEELTNFYVNKVREISQK

SEQ ID NO: 13296 - protein, 474 aa, Gracilariopsis longissima
RYESGVIPYAKMGYGLPDYVIKVTDVLALFRVSPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRAVAASGEIKGHYMNVTAATMEEMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNESRDYVAEGPEILRDAAKTCGPLQTALDLWKDITFNYTSTDTADFVETPTANV

SEQ ID NO: 13297 - protein, 85 aa, Zea mays
  unsure (1)..(85): unsure at all Xaa locations
LEEEVVXAXSMLSSXAXXVPXRSQXXMXXXFXGLKSXAXFPVTRKAXNDITSIASNGGRASCMKVCPPVXXXKXXIFLPAPPLPS

SEQ ID NO: 13298 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 13299 - protein, 637 aa, Rickettsia sibirica
MNNQGRSILAWAALFIFVILLFNVFQSDSLLGGRNNITFSDFLTRVDEKTVNSVKIQGRVIEGTSNDGSTFNTYAPDYPDLVNRLTSNDVNIEVVPLETRMNTFLGFLISWFPMLLLIGVWVFFMRQMHGGGKAMGFGKSKARLLSDKGPKITFKDVAGIDEAKEELTEIVDFLRDPSKFQKLGGKIPKGCLLIGPPGTGKTLLAKAIAGEANVPFFSISGSDFVEMFVGVGASRVRDMFEQGKRNAPCIIFIDEIDAVGRHRGIGMGGGNDEREQTLNQMLVEMDGFEANEGVVIIAATNRPDVLDRALLRPGRFDRQIAVANPDINGREQILKVHLKKIKYNSTVLARIIARGTPGFSGAELANLVNEAALIAARLGKKEVDMHDMEEAKDKVLMGVARRSIAMSEKEKRLTAYHEGGHALVGLYCPAASPIHKATIIPRGNALGMVQRLPETDEYSQNREQMESSIAVYMAGRVAEEIIFGRNKVTSGASSDIKGATNIARAMVTKAGLSDLIGPIFHGSSGDDMYGRQPNNETSEATAELIDAEVKRIITQGYEFAKDILTKHIDQLHTLANALIEYETLSGQQIKNLLSGRALDSEEENKFPFNDSSTIKIDKDKSPEKTKTTKAKKENYAS

SEQ ID NO: 13300 - protein, 443 aa, Zea mays
MSASRSGRRRTGSVALGDLLQREASAERAALGCGERPSVAAGQACRAKKGEDFALLKPACERRPGAPSTSFSAFALFDGHNGSAAAVYAKEHLLGNVLSCVPTDLAWDDWLAALPRALVAGFVKTDKDFQTKAHSSGTTVTLAIIDGSVVTVASVGDSRCVLEAEGSIYYLSADHRFDANEEEVGRVTECGGEVGRLNVVGGAEIGPLRCWPGGLCLSRSIGDQDVGEFIIPVPYVKQIKLSNAGGRLIISSDGVWDALTAEMAFKCARGLPPEAAAEQIVKEAVEAKGLRDDTTCIVIDIISPEKPKRTIQSQRSPRKGLVLLKNFFLRKTASDSLSLPDKDNYPEPDLEEVFEDGCPSLSRRLNSEYPVRDMFKLFACAICQIDLESGQGISIHEGLSRPGKLRPWDGPFLCHSCQEKKEAMEGKRHSRDSSSRNSGSSES

SEQ ID NO: 13301 - protein, 250 aa, Oryza sativa
MSRRYDSRTTIFSPEGRLYQVEYAMEAIGNAGSALGVLAADGVVLVGEKKVTSKLLQTSRSAEKMYKIDSHLACAVAGIMSDANILLNTARLHAQRYALSYQEPIPVEQLVQSLCDTKQGYTQFGGLRPFGVSFLFAGWDKHHGFQLYMSDPSGNYSGWKAAAVGANSQAAQSMLKQDYRDGMTREEAVALALKVLSKTMDSTSLTAEKLELAEVFLQPGTGEVQYQVCSPEAMGKLLAKAGLSQPAPEA

SEQ ID NO: 13302 - protein, 492 aa, Oryza sativa
  unsure (1)..(492): unsure at all Xaa locations
MDAAMESAVGPHFSGLRLDSRRLSSSSLPTSPSAASSNGCGGNDAPAAVNGFAPPPPPSAAAAAEEGSKQPFVIGVSGGTASGKTTVCDMIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPPWGDNIVAIXLGQHDLCKIYPHVYVVQTTFQIRGMHTLTRDIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGNSANQAIELLISSGVPEERIMFLNLISAPEGVHCVCKRFPRLKIVTSEIETGLNEEYRVIPGLGEYGDRYFGTD

SEQ ID NO: 13303 - protein, 370 aa, Clarkia breweri
MGSTGNAETQLTPTHVSDEEANLFAMQLASASVLPMVLKAAIELDVLEIMAKSIPHGSGAYISPAEIAAQLPTTNPDAPVMLDRVLRLLASYSVVTCSLRELPDGKVERLYGLAPVCKFLTKNEDGVSLAPLCLMNQDKVLMESWYYLKDAILDGGIPFNKAYGMTAFEYHGTDPRFNKVFNRGMSDHSTITMKKIFEMYTGFEALNTIVDVGGGTGAVLSMIVAKYPSIKGINFDLPHVIEDAPIYPGVEHVGGDMFVSVPKGDAIFMKWICHDWSDEHCLKFLKNCYAALPEHGKVIVAECILPLSPDPSLATKGVIHIDAIMLAHNPGGKERTEKEFEALAIGAGFKGFKVACCAFNTYVMEFLKTA

SEQ ID NO: 13304 - protein, 105 aa, Zea mays
  unsure (1)..(105): unsure at all Xaa locations
IASVHKKDGCNVPVLVVNCFNTDDDTQKSAGQCSNSDMEMHTVSRSQHAWIGTGGLLPLPSEGKSAKDGWXPPGHGGVFPCMTNRGKLDRLLAQGTELVCVANLH

SEQ ID NO: 13305 - protein, 326 aa, Rickettsia sibirica
MDIKLGKYKPTKEEYIKSFKDMLLLRRFEEKCGQLYGMGEIGGFCHLYIGQEAVISAVDMVKQKGDSTITSYRDHAHIILAGTEPKYVLAELMGRATGCSKGKGGSMHLFNVPNKFYGGHGIVGAQVPIGTGLAFAEKYNDTHNICFTFLGDGAVNQGQVYEAFNMAALWGLPVVYIIENNEYSMGTSVARSTFMRDLYKKGASFGIKGFQLDGMDFEEMYDGSKQAAEYVRENSFPLILEVKTYRYRGHSMSDPAKYRSKEEVEQYKERDPLVIIRKTILDNKYVTEADLKAIEQSVKEIVKEAVEFSENSPLPDEGELYTQVYC

SEQ ID NO: 13306 - protein, 170 aa, Glycine max
  unsure (1)..(170): unsure at all Xaa locations
AASLIASPPVCTDHRAGAGLDAPFIRLTSMHGCPPRKTNHDFPSLACYGGRVRCMHACAPIGWKKYETLSYLPDLAHARLVEEGKYLPSKGWMPCLLVILDHGLVHRARARPPACYHGRYXPMRELAIYGCTDASHAWEELPXARTDCPPGCLRINGCNCLRSAQGMSFI

SEQ ID NO: 13307 - protein, 248 aa, Neurospora crassa
MARKFFVGGNFKMNGTRKDLKAIVDNLNNAQLDPNAEVVIAPPALYLDFVKQNLQKPNVEVAAQNVFNKPNGAFTGEISATQLLDLGVKWVILGHSERRNELGESDEFIASKTKYALDNGISVIWCCGESKDTRQAGETIKFVENQLAALAKEINDWKNVVIAYEPIWAIGTGLVATKEQAQEVHAAIRSWLKQNVSDKVAEETRILYGGSVNAKNCKDLAKEQDIDGFLVGGASLKPEFVDIINANL

SEQ ID NO: 13308 - protein, 311 aa, Staphylococcus capitis
GFGRIGRLAFRRIQDVEGLEVVAVNDLTDDEMLAHLLKYDTMQGRFTGEVEVIDGGFRVNGKEIKSFDEPDASKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLDKQDVTADQVNEAMKQASDESFGYTEDEIVPSDVVGMTYGSLFDATQTRVMTVGDRQLVKVAAWYDNEMS

SEQ ID NO: 13309 - protein, 728 aa, Halobacterium sp. NRC-1
MKTLERDLGLGAVFAISVGAMIGSGIFILPALALKMAGPAVIVAYLLAGLLVVPAALSKSEMATAMPEAGGTYIYIERGMGPLLGTVAGVGTWFSLSFKSALALVGGVPYLVLLFDLPVQPVALGLAALLIVVNLLGAKQTGRLQTVIVSLMLGALGWFVAGSAGQVQQANFQGFLTGGWEGLLAATGLVFVSYAGVTKVASVAEEVENPDRNLPLGILGSLAFTTLLYVGIVAVMVGVTDSGAVAGSATPVAVAADATLGTAGVYAVIAAAVLALVSTANAGILSSSRYPFAMSRDQLAPPTFAEIHDRFGTPTTAITLTGAVVLALIAFVPILDIAKLASAFQILVFVLVNLALVAFRTGTTDYDPDFESPLYPWMQGFGVLSGLALLTQMGWVPIAGAAVITLGSVVWYRVYARPRVRREGAATDVVRRRLGRDVLTETEALVDATGAEAGGPEVLVALTREASADRERALLSLAADRARNEDGQVVVVRFDEVPDQAPLDHAADVQSPADVRFEERTEGLSTEFDVDIAYGEVVSHDTKRAILNVAEQRSVDTVVAEHERLRLRSRLLGDPIDWVVRHAPCDVLLVENRGYDAPQNVVLEGDGGPYDPATVAVADAVAGAAGGTVTLQFPLSADHPDKRQETVHAYQDELAGLLSAPVRTADLRADGGDQTAPDLVVRTGAHRRVRGGRGSHTQTAADCTELTVYPHESRQPGLLRRLAERLVF

SEQ ID NO: 13310 - protein, 539 aa, Magnaporthe grisea
MPSLGFLKKKRTRDGNNDNSSQPASPVTPTAAQSFEQAQVLGAPSAINNSHAHTQQQSYLVPQPGYSVGTEVQAQQPQMNSISQQQQQAFAPPAHTPSPGTIDPQQSLPSISNLMNPAVQQQNSQPSANFQPQSQSQSQSQSQFPLPPSHGNGDQSQQQNFQVQQQIQSQQDAMDIQPSQVQDQSHSQQAQPQHQPQHHVQHHVNHAHQGSQDQQTRVTKGKYSLTDFEILRTLGTGSFGRVHLVQSRHNQRFYAVKVLKKAQVVKMKQVEHTNDERKMLGEVKNPFLITLWGTFQDCRNLYMVMDFVEGGELFSLLRKSGRFPNPVAKFYAAEVTLALEYLHAKNIIYRDLKPENLLLDRHGHLKITDFGFAKRVPDKTWTLCGTPDYLAPEVVSNKGYNKSVDWWSLGILIYEMLCGYPPFWDSGSPMKIYENILKGKVRYPAYINPDAQDLLQRLITADLTKRLGNLYGGSQDVRNHPWFAEVTWDRLARKDIDAPYTPPVKAGAGDASQFDRYPEETERYGQTGHDEYGNLFPGF

SEQ ID NO: 13311 - protein, 1013 aa, Arabidopsis thaliana
MKFIYNPTLRHVTVCVIKSKAFLANNGRKTTRVGMDHPDPIRKRYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 13312 - protein, 632 aa, Glycine max
RRNLRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDDAVIRRMPRRLMVNLPDAPNRAKILKVILAKEDLSSDINMDAIASMTDGYSGSDLKNLCVTAAHRPIKEILEKEKKEQAAAVSEGRPAPALSGSADIRSLNMEDFKYAHQQVCASVSSESINMTELQQWNELYGEGGSRVKKALSYFM

SEQ ID NO: 13313 - protein, 356 aa, Neisseria meningitidis Z2491
MTKHIAILRGDGIGPEIVAETVRVLDKLIAQGLDVGYEYAPLGGEAYDEYGHPYPEFTQNLCRKADAVLLGAVGSPQYDNLDRPLRPERGLLAIRKDLNLFANLRPAILYPELANASTLKSEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATVLSLAMLLRYSLNDEARAQQVENAVQKVLQQGLRTGDIYEEGTKLVSCSEMGDAVLATL

SEQ ID NO: 13314 - protein, 264 aa, Zea mays
KLNLHCSEETKNAEWSGPMGIVVSVALSSVFGWIYLVALTSAVTADDVPSLLDPTNDAGGNAIAQALYATFRRRFGSGAGGVLCLAAMAVAIFLCGVASVTSNSRMGYAFSRDGAMPLSQVWYRVNKQEVPFNVVWLSVSVAFVMALTSLGSQVAFQAMVSITTLGMYIAYALPIFFRVSAARNSFVPGPFHLGRRCSLVVGWVAVLWVALVTVLFCLPVAYPVAGVNFNYTPVAVGGVLVLSLGAWVLHARFWFRGPVTTIDA

SEQ ID NO: 13315 - protein, 584 aa, Arabidopsis thaliana
MARTTRERVKSFINNRWLVFVAAMWIQSCAGIGYLFGSISPVIKSSLNYNQKQLSRLGVAKDLGDSVGFLAGTLSEILPLWAALLVGSVQNLVGYGWVWLIVTGRAPILPLWAMCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRDYAYPRPVAIAVAQLVMSVGHIFFAYGWPGAMHIGTLLIGLGYGAHWAIVPATASELFGLKKFGALYNFLTLANPAGSLVFSGLIASSIYDREAERQAQGSLFNPDDVLRCRGSICYFLTSLIMSGFCLIAAALSMILVQRTKPVYTNLYGKTRN

SEQ ID NO: 13316 - protein, 363 aa, Triticum aestivum; identical to SEQ ID NO: 10951

SEQ ID NO: 13317 - protein, 479 aa, Glycine max
MNPDQFQKNSMFVETPEDGGKNFDDDGRVKRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHDKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFSLFGTFPVNFFRVVWRTTYVIITALIAMMFPFFNDFLGLIGSLSFWPLTVYFPIEMYIKQSKMQKFSFTWTWLKILSWACLIVSIISAAGSIQGLAQDLKKYQPFKAQQ

SEQ ID NO: 13318 - protein, 191 aa, Microbulbifer degradans 2-40
MAKSIGTLLAVSSVVAIAAVFSQVGLVSQTIADEINAEPDMSMTVAQAQQLVARGENLTSIPKHIWRQLLTKHEYNIMWEKGTERAFTGDLLEVQQPGVFVTAGCKLPVFKTEHKFKSGTGWPSFWDVVDKNNIILKDDSSWGMRRIEVLSACGEHLGHVFDDGPEPTGLRYCINSAALDFIAADTAEPEE

SEQ ID NO: 13319 - protein, 251 aa, Bradyrhizobium japonicum USDA 110
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 13320 - protein, 330 aa, Brucella melitensis 16M
MATFDVLCIGNAIVDILARTDDVFLETNGIIKGAMNLIDAERAELLYSRMGPATEMSGGSAGNTAAGIASLGGRSAYFGKVATDHLGRVFAHDIRAQGVAFDTRPLEKGSPTARSMIFVTPDGERSMNTYLGACVELGPEDVETSKVADARVTYFEGYLWDPPRAKEAIVMASKIAHESGRQMAMTLSDPFCVDRYRDEFLQLMRSRTVDIVFANEDEAKALYKTKSLETAIAAMRMDCRLSVITRSEKGAVVVTPDQTLTVPAIEIDDLVDTTGAGDLYAAGFLYGYTKDRSLEDCARLGSLAAGLIIQQMGPRPQISLEAAASQAGLI

SEQ ID NO: 13321 - protein, 286 aa, Glycine max
MYRERGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 13322 - protein, 199 aa, Zea mays
  unsure (1)..(199): unsure at all Xaa locations
VRPFPLFFLQPSKRPAKQGTQIESSPCHARKAPAAHDGNGNGGAAAAAAPKGCVTVRVGLEGEEQRRFAVPLGHLKHPLFGALLEEAEREYGFRHQGALAIPCRVDRFVQLERLIGRDLQGACAHHLVHLGEARXAXDQQEHQHHLHLPPFERYFRAVQQPHAARVLREVREPRALREPGPRAHDAALLQPPEEGPLHV

SEQ ID NO: 13323 - protein, 732 aa, Azospirillum irakense
MKVHQLFKAALATSLCLTAFAGGAMAQAKGAWQNTSLSPDERARLLDAELTLDERISLLHGPMPLPFPGSPPIPEGPSLVPVIFPGVPRLGIPALKETDASLGVTNPMNVRPGDTATALPSGLALASTFNPKLSYDGGAAIAKEAASKGFNVLLAGGANLARDPRNGRNFEYLGEDPLLAGILAGESIRGIQSQNIISTVKHFSLNGQETNRHWGNSVIDEAAHRESDLLAFQIAIERGQPGSVMCAYNLVNGAYSCGNDHLLNKVLKGDWGYKGWVMSDWGAVPATDFALKGLDQQSGQQLDEKIWFGDLLKEAAAAGTIPAERLSDMSRRILRSMFAAGFFDGKPGKPVVDLDAHAAIAKQVADEGIVLLANDKGLLPLAAGSQKIAVIGGFADQGVLSGAGSSQVTSVGGNPVVIPVGGEGMLAAFLRQAYHNSSPLKALKERLPNATIRFNDGRYSAAAAALARQSDIVILFANQWMSEGMDAYDLKLPQGQDALIEAVAEANPNAVIVLQTGGPVLMPWKDKVGAIVSAWYSGQKGGEAIADILVGKTNPSGRLPSTFPASADQYPHPEVPGWNLPEKQQFDVVYEEGSDVGYRRFAAKGMKPLFPFGHGLSYTTFAYDKLKVKGGETLEVSFQVTNTGKLQGKDAPQIYLAGANGQKLQRLIGFEKIDLKPGERRTVTIKADPRLLARFDEQGHQWRIDGGDYDVVVGRSATMTVLSGKAASASVP

SEQ ID NO: 13324 - protein, 62 aa, Triticum aestivum
PGERPPPMAPARQERFIPRWIAALWAPPLPHEIRAIGLSHGSQADKSLGQKLATRFSSNPGR

SEQ ID NO: 13325 - protein, 177 aa, Triticum aestivum
AGPSSSIKKLGGAFVAATAVVPDEVDKIKEILVKWSDIDRVNLILTLGNNVHAGGTGFTPRDVTPEATKSVIEKEAPGLAFVMIQESLKVTPFAMLSRAACGIRGSTLIINMPGNPNAVAECMEALLPALKHAMKQLKGDKREKNPRHIPHAEATPVDQWERSFRAASSGGGCSCDP

SEQ ID NO: 13326 - protein, 190 aa, Zea mays
  unsure (1)..(190): unsure at all Xaa locations
ITMDPTKFRPSSSHDTTVTTTNAGAPVWDDHEALXTVGPRGPILVGDXHLIEKGAHFPRGNAIPETRGCTPPGGPPAQGFLSRGPPQRGTLLERGAQIFLGGGPGGGGNPPGKTGGFFPEGETPKRGGAPPGKKNPANPRGGVPPPGRNFSTPPGGRKNGDTPGVGKKKISPRFFFFFGRGGFKFFPPQG

SEQ ID NO: 13327 - protein, 277 aa, Beta vulgaris
  unsure (1)..(277): unsure at all Xaa locations
EDLQLLPKILTWCRXIHLFVGVVYCLISWTVGLPKRAPIDGTLLKLLIPVAVCHALGHVTSNVSFAAVAVSFTHTVKALEPFFNAAASQFILGQPIPITLWLSLAPVVIGVSMASLTELSFNWLGFISAMISNISFTYRSIYSKKAMTDMDSTNIYAYISIIALFVCLPPAIIVEGPQLIKHGFNDAITKVGLTKFVSDLFWVGMFYHLYNQLATNTLERVAPLTHAVGNVLKRVFVIGFSIIIFGNKISTQTAIGTSIAIAGVAIYSFIKAKMEEE

SEQ ID NO: 13328 - protein, 729 aa, Eremothecium gossypii
MLYSDELGLPTTDSRRWRLFCDEVGAERWEYMDEQETSKVPQTTCVQWLLNVPSFPTPEPEVSSKDQGFTAANAAYNGARFLGLLQDEASGTFPCSYRGPMFMTIGYVVAMHVGGVVIPEPQRRELVRYVVNTAHPVDGGWGLHSEDKSTVMGTALNYVLLRLLGMEREHIVMQRARKTLLRMGGAIGSPYWGKVWLSVLNLYKWEGVNPAPPELWLLPYQFPYHPARWWVHTRAIFLPMSYLAGVRYQCALTPLLEEIRSEIFTRPFEEIDFAANRNNVCGIDLYYPHTTVLNTLNKCIVGYEKYLRPNWLLKYSLNRIYELIKMEIQNTDYLCIAPVNNALNAIVTCIEEGPDSAEFGRFLDRFKEVLFLGPQGMLVMGTNGVQVWDCAFYIQSMFAANLQDKPEFYENIVRAYRFLCRSQITDDCVPGSYRDPRIGAWPFSTKTQGYAVSDCTAEAAKSVLLVRNSPVFKEVRDEISSEKLQKAIDALLGLQNLGSFKYGSFASYEKIRAPLSIESLNSAEVFANIMVEHPYVECTDSSVLGLSFYRKYHDYRQDEVDHAIKIAVKFIKSAQEKDGSWYGCWGICYTYAGMFALEALHNAGESYADSEVVKKGCEFLVSKQLPDGGWSETMKSSELHTYVSDKRSYVVQTAWALIGLLLADYPDRKVIDRGIQLLKERQLPSGEWKYESIEGVFNHSCAIEYPSYRFVFPIKALGIYSKKYAKDAL

SEQ ID NO: 13329 - protein, 338 aa, Yersinia pestis CO92
MQKKSIYVAYTGGTIGMQRSDNGYIPVSGHLQRQLALMPEFHRPEMPDFTIHEYAPLIDSSDMTPEDWQHIANDIQQNYDLYDGFVILHGTDTMAFTASALSFMLENLAKPVIITGSQIPLAELRSDGQTNLLNALYLAANHPVNEVSLFFNNQLFRGNRTTKAHADGFDAFASPNLSVLLEAGIHIRRQSSVVSPTSNGPLIVHRITPQPIGVVTIYPGISGAVVRNFLLQPVKALILRSYGVGNAPQKAELLDELKNASDRGIVVVNLTQCISGSVNMGGYATGNALAQAGVISGFDMTVEAALTKLHYLLSQSLSPNEIRQLMQQNLRGELTDTQ

SEQ ID NO: 13330 - protein, 329 aa, Thermosynechococcus elongatus BP-1
MSQPTVLCAGEVLFDCLEIPPDPPQCFLGGAPANVACGLVKLGVSAAFLGAVGEDPLGERACAELAALGVNIEAVERVAGLPTRQVRVQLVEGDRQFVGFAPAGTSVFADMQFCGQQVSPLLLTGARFFVTGTLGLASEPTATTIAHLVHQLRQKGTLILIDANWRPIFWSDPRVAPERICPFLAQAHFLKLAKEEAELFFSDSDPQVVYRALWGRAPDHGVVITDGDQAIRYFWHENQGELQPPSMSVVDTTGAGDGFVAGWIAQLLQGTPETYRDPAWQVACLEFATVVGALVTTKRGAIAGQPTLAEVRQWLRDHPQRKIQTHSTG

SEQ ID NO: 13331 - protein, 146 aa, Pediococcus acidilactici
TIADTIENYSELYVQSQNATFLSIDDPDNMETALKNAADGRDIRLIVVTDAEGILGIGDWGTNGVDISVGKLMVYTAAAGIDPSQVLPVVLDVGTNNEKLLKDPMYLGNRHERIKGDRYFEFVDQFVQTAENLFPNMYLHFEDFGA

SEQ ID NO: 13332 - protein, 315 aa, Triticum aestivum
  unsure (1)..(315): unsure at all Xaa locations
FKRQKNGGAFVASFHPPRRAGPAPAAQPQPEPPRSASGAPRRRAQPLVRHGPVSGKFLAGGNGKCNGTKVSISKLVSDLNAATLESDVDVLLVTXRFIYYDDVKRXLTXDRIEVSGCIIXIGKGGAYXGEFTAGELXDIGLPMGLVLGTLERQSYYRQMIISLLEYIGCICLESKSXGFGVMACIGGXEREAGKTFNXDVCLKQMKAFADNITDWTNVVIAYEPVWAIGTGKFASPEQAQEVHAAVRDWCXKTNVSXDVASTVRIIYGRFQLNATNKEGXIEGFLVGGALVVKXRLNGPHFATICNSVTSKKVTA

SEQ ID NO: 13333 - protein, 502 aa, Prochlorococcus marinus subsp. marinus str. CCMP1375
MTTALQSPPRRRIARLQEVSLLEGPMLLLRSIRGFRSNQSLIWLATVPLALLGLGVFGFAARAGVGLSDLSGAQAASFLADNLWLFIATILVIFMNAGFAMVEAGMCRQKNAVNILAKNLFVFALAVTAYWFIGYSIMYGGTPIIGGVIFSNGFFFNPDPSDALSCAAGLGADGCSQLVPAVDFLFQAAFAGTAATIVSGLVAERVKFGEFVVFSLVLTAFIYPIAGSWQWNGAGWLSQLGFIDFAGSSIVHSVGGWAGLVGAMLLGPRIGKFVDGKPQAMPGHNMAIATLGALILWIGWYGFNPGSELAMDEYVAYVAVTTTLAAAGGAIAATLLSTLTSGKPDLTMIINGILAGLVSITAGCGNMTLSGSWLAGFVGGLIVVFAVSALDSAGIDDPVGAFSVHGVCGVWGTVVIGLWGVDGMDPGAAGIGLFNGGGLNTLLIQALGAGAYAIWTVVTCWLAWTVIGGFFGGIRVSEEEEIQGLDIGEHGMEAYPDFASSN

SEQ ID NO: 13334 - protein, 385 aa, Porphyra yezoensis
HYPDSIRRTKELEKQGILFVGTGVSGGEEGARYGPSLMPGGHPEAWPHIKDIFQAISAKSGDEPCCDWVGENGAGHYVKMVHNGIEYGDMQLICEAYSLLRTVLGLSNDKCADVFDEWNKGSLDSYLIEITANILRYKDTKDGKGDADTPSLVDKIMDRAQQKGTGKWTVGTSLDMGVPVTLISEAVFARMLSSMKEERVRASEKLSGPSSEFKGNAADFIEAVRQALYASKIVSYAQGYMLFREAAKEYNWNLNYGGIALMWRGGCIIRSAFLGDIRDAFTNDPELENLLLSPYFKKEVAGCSEGWREAVAVAARQGVPIPAFMTALAFFDGYRSATLPANLLQAQRDYFGAHTYERVDKKVGEYFHTNWTGTGGDITSNAYAA

SEQ ID NO: 13335 - protein, 278 aa, Laelia anceps
MNRVETVNKENYRRFREQRFKEFAAKTLESGEKVDADNLDWESTFFLRHLPTSNISQIPDLDDDCRSTMKEFAGELEKLAERLLDLLCEDLGIEKGYLKRVFCGGSDGLPTFGTKVSNYPPCPKPELIKGLRAHTDAGGIILLFQDDKVSGLQLLKDGQWIDVPPLRYSIVVNIGDQLEVITNGKYKSVMHRVVAQTEGNRMSIASFYNPGSDAVISPAPALVEKEAEEEKKETTYPKFVFQDYMNLYIRKKFEAKEPRFEAMKTMETVSGSQLIPTA

SEQ ID NO: 13336 - protein, 258 aa, Triticum aestivum
TITREVVQGSYFHVNSVETEKQLALLSSSGHSSSTNSSGSDDWVDPAAYVLNSTALRTREHWILVDAFRRLQRGPNVQRRVMSLSGDGTGWDAVMNNEAVQEFRRSFQDGKEVNRKGNSCGPAVVLKWILANTQAKITEFFDNIAKIVSMLFHPQSDEDKPDLYSDAVKVSFMLSVFVFIVVAVAPYQVRANTPPTVTVAGFQRPRIVSLHGRTSLVLERLLGRSLGLRDFGFERAQTIAGVGNQWVGLKCLKPAMQC

SEQ ID NO: 13337 - protein, 315 aa, Capsella rubella
MGTILKLPIIDLSSPEKLSTSSLIRQACLDHGFFYLTNHGVSEELMEGVLMESKKLFSLPLDEKMVMARRGFRGYSPLYEEKPHSSTLAKGDSKEMFTFGSSEGVLAQIYPNEWPREELLPLWRPTMECYYKTVMDVGKKLLGLVALALNLEENFFEQVGGFNAQAAVVRLLRYPGELNSSGEVTCGASAHSDYGMITLLATDGVPGLQVCRDKDKEPKVWEDVAGVKGAFVVNIGDLMERWTNGLFRSTMHRVVSVGKERYSVAVFVDPDPNCVVECLESCCSETSPPRFPPVRTKDYFHERFSQTLASYSGSG

SEQ ID NO: 13338 - protein, 249 aa, Brassica napus
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 13339 - protein, 405 aa, Oryza sativa
  unsure (1)..(405): unsure at all Xaa locations
MWRLKVAQGGGALLRSTNGFAGRAVWEFDPYHGTPEDRANVERVLXYFTDHRLRRPESADLLMRMQFARENNHQRRGDRIPPAVNKLGEKEHVTEETVMASLRRALDEFSSLQAHDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLXGKFWGPTRVVYVPMAYLYGKKFVGPITPTILALREEIYTDPYHTIDWAQACNACSKSSLLQRRSNASGGARGAASGRGWRAVGTKGGGGGGRRGLRGDASRRAEERRAAQAAGRRRERRGGASSGATGAAGSGRSAVRRRRRHGCVYYTIGDGRRIWSARARCCRMWCGLRSTSGWSRC

SEQ ID NO: 13340 - protein, 506 aa, Glycine max
  unsure (1)..(506): unsure at all Xaa locations
MATPLAYQEHLPAAPSWLNKGDNAWQLTAATLVGLQSMPGLVILYASIVKKKWAVNSAFMALYAFAAVLICWVLVCYRMAFGEELLPFWGKGAPALGQKFLTKRAVVNETIHHFDNGTVESPPEEPFYPMASLVYFQFTFAAITLILLAGSVLGRMNIKAWMAFVPLWLIFSYTVGAFSLWGGGFLYQWGVIDYSGGYVIHLSSGIAGLTAAYWVGPRLKSDRERFPPNNVLLMLAGAGLLWMGWSGFNGGAPYAANIASSIAVLNTNICAATCLLVWTTLGVIFFGKPSVIGAVQGMMTGLVCITPGAGLVQSWAAIVMGILSGSIPWVTMMILHKKSTLLQKVDDTLGVFHTHAVAGLLGGLLTGLLAEPALCRLLLPVTNSRGAFYGGGGGMQFFKQLVAAMFVIGWNLVSTTIILLVIKLFIPLRMPDEQLEIGDDAVHGEEAYALWGDGEKYDPTRHGSLQSGNTTVSPYVNGARGXDYKLMSQEIRLCLAHTCMCINLYD

SEQ ID NO: 13341 - protein, 157 aa, Chlamydomonas reinhardtii
MALLATRRVSVPCTRQARRIAVPSSVRSRGALQVKALFGGGQGGGGNPFDMKNLMESVKKAQQLVQTETARVQAELAATEFEGYDEEETVRVIMSGNQEPKGVEITQAALDLGAEECSKRTTDAMRDAHKKSVTGMKEKMRELAKNLGIPNPGALNM

SEQ ID NO: 13342 - protein, 510 aa, Zea mays
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 13343 - protein, 763 aa, Bacteroides thetaiotaomicron VPI-5482
MAKITKEAALLYHSQGKPGKIEVVPTKPYSTQTDLSLAYSPGVAEPCLEIEKNPQDAYKYTAKGNLVAVISNGTAVLGLGDIGALSGKPVMEGKGLLFKIYAGIDVFDIEVDEKDPEKFIAAVKAIAPTFGGINLEDIKAPECFEIERRLKEELDIPVMHDDQHGTAIISSAGLVNALQVAGKKIEDVKIVVNGAGASAVSCTKLYVSLGARLENIVMLDSKGVISKTRTDLNEQKRYFATDRTDIHTLEEAIKGADVFLGLSKGNVLSQDMVRSMAPMPIVFALANPTPEISYEDAMSARPDVLMATGRSDYPNQINNVIGFPYIFRGALDTQAKAINEEMKIAAVHAIANLAKQPVPDVVNTAYHVNNLSFGPEYFIPKPVDPRLITEVSCAVAKAAMESGVARTEIKDWDAYCVHLRELMGYESKLTRQLYDTARRNPQRVVFAEGIHPNMLKAAVEAKAEGICHPILLGNDEAIGKLAEELDLSLEGIEIVNLRHPDESERRERYSRILAEKRAREGFTYEEANDKMFERNYFGMMMVETGDADAFITGLYTRYSNTIKVAKEVIGIQPGFNHFGTMHILNSKKGTYFLADTLINRHPDTETLIDIAKLADKTVRFFNHTPVISMLSYSNFGADTSGSPVKVHGAVNYMQKEYPELAIDGEMQVNFAMNRELRDAKYPFTRLKGKDVNTLIFPNLSSANAGYKLLQAMDPDTEFIGPIQMGLNKPIHFTDFESSVRDIVNITAVAVIDAIVVKKKNESR

SEQ ID NO: 13344 - protein, 331 aa, Listeria monocytogenes EGD-e
MTLKEAGLTEDKLIKMYETMLMARRLDERMWLLNRSGKIPFTISGQGQETAQIGAAFAFDLDKDYALPYYRDLAVVLAFGMTAKDIMLSAFAKAEDPNSGGRQMPAHFGQKSNRIVTQSSPVTTQFPHAAGIGLAAKMAGDEIAIYASTGEGSSNQGDFHEGINFASVHKLPVVFVIHNNQYAISVPASKQYAAEKLSDRAIGYGIPGERVDGTNMGEVYAAFKRAADRARNGEGPTLIETVSYRFTPHSSDDDDSSYRSREEVNEAKGKDPLTIFQTELLEEGYLTEEKIAEIEKNIAKEVNEATDYAESAAYAEPESSLLYVYDEEANS

SEQ ID NO: 13345 - protein, 337 aa, Acrosiphonia duriuscula
MPRNRDDSPDGAYLIHGRYEKIEKLGEGTYGKVYKARDSKTDQVVALKKCRLQLDAEGVPPTTIREVSLLQVLSRSNHVVKLLGVEQIEEDGKVVLYLIFEYLQHDLKKFMDFKKKEKHNPLQPELVKPYLFQLIRGMAFMHQHGVMHRDLKPQNLLVDPKTNVLKIADLGLGRVFALPCKAYTHEIVTLWYRAPEVLLGTKIYSLPVDVWSIGCIFAEMVKGIPFFPADCEIAQLFMIFQVLGTPNEEVWPGVTSLRDWHMYPQWQPMDLHTHLEGLLDHQGCDLLKKMLVYNPNKRIPAKQAMKHPYFDDLDMEVMDALENPEVLNAGMEYQENA

SEQ ID NO: 13346 - protein, 349 aa, Sinorhizobium meliloti
MSGATLEAYLASCTTHGDELSRDVAAVIQRLAKAALDIRKLVNQGALGTVFNGMHSGSNTDGDVQKDLDILCDDQFLSCLQGAPVACYASEELENPVLLDPAARLAVAIDPLDGSSNIDNNISIGTIFSVLPAAKGPDVDPSHSFLQPGNRQLAAGFFVYGPQTALVLSLGRGTDIFIFSSRLGCFVDAYKSVGIPDRANEFAINMSNYRHWEEAIRLYVDDCLAGSEGPRERDFNMRWIASLVAEAYRILVRGGIFLYPADSRKGYSHGRIRLVYEANPIAFIVENAGGSATTSVDRILDLVPESLHQRVPLVFGSRREVGRITRYHVDPNMIGERAPLFGKRGLFRA

SEQ ID NO: 13347 - protein, 84 aa, Zea mays
  unsure (1)..(84): unsure at all Xaa locations
PERVVHARGASAKGFFXCTHYVTSVRCAYLLRAPDMRTPVIVRFXTVIHERWCLKTMRDPRGFGVKFYTRXGNWNLLGNNCRVF

SEQ ID NO: 13348 - protein, 481 aa, Oryza sativa
  unsure (1)..(481): unsure at all Xaa locations
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSAEFFXHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 13349 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIENCKIHHAVVG

SEQ ID NO: 13350 - protein, 400 aa, Schizosaccharomyces pombe
MKMQVSTREWILTLRLLKDLEDMDSIGDNVTEMDAFVRDLTMKPYAELEKRKAELHAQKLKLVQKRQQLLRDNYNVLVDYARNQDAFYQLLENSRHDFKELVLHTNQLYEPVKRSQNFLTSISEHYRDAKLMHQVQPQLSSILELPELMNACIERNYFSETLEFQALAYRLKDRFGTNSIIQELITQVETLVVKLTEKLILQLQKPLKLYSLIKVVTYLRVTAKLSEAQLKYVFLYFSWKQLQTSLRNLVPLLDYNNPELYLRRYIQVIRDRAFSLLFQYQSVFGESSNDRLNAAGTVDIPNSTSTSASPFEMDPEGFNNFGQNILSSFVRKLQLEICYVLQKFMPNVKDSTSKFSLLLQLYYCNQSLTKVGTDISIPLSKILGSEWLEMIHSQSSEKQA

SEQ ID NO: 13351 - protein, 475 aa, Bacillus subtilis subsp. subtilis str. 168
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 13352 - protein, 512 aa, Vicia faba
MAAIGVLKVPPSSSSSSSSSSSKAIARNLSFTSSHLSGDKIFTLSGRTRRTSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVAALPMDEARATAFGLMKIDEEGRIIEFSENPKGEQLKAMKVDTTILGLDDDRAKEMPYIASMGIYVVSKHVMLDLLRDKFPGANDFGSEVIPGATELGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIRRAIIDKNARIGDDVKIINSDNVQEAARETEGYFIKSGIVTVIKDALIPSGTVI

SEQ ID NO: 13353 - protein, 85 aa, Capsicum annuum
MAIRVPRIIKKSSTSLDVPKGHFAVYVGEKQKNRFVIPISYLSQPSFQDLLSRAEEEFGFDHPMGGVTIPCSEDIFIGITSKFRI

SEQ ID NO: 13354 - protein, 1394 aa, Oryza sativa
  unsure (1)..(1394): unsure at all Xaa locations
MQQFVCHTMHTTSCSMHRCTGSTNAQHSRNAQANHRQGAQGSRRRRFGRGGRRRGSCRIELRVDGFGRVERELDSIFAEARGRRRREREREREGRHMRVTVTPKDEERLVVLMARERPRSAVVAPGGDLVTAGGGGGGGGGGEGSDGDSSGSLEEISADDFKKESSAAGGAAAAAAAQQRSRVWMGYNIPRSYAPAFHSFAWAQAVQNKPLVPRAADAADEDEVEHVVDTSDEEKEEGEIEEGEAVQTTTTSSSSPPCAQPPETIDLDSDAPEKSESMVAMYGGGAAPAGAEEEEVDFDQRVGSILEELEMVSIEEAEKYGLMILLYGKVHVLDVFWCMIQLLRDPILMFCRSFEGACTRLRTCFENLKPLFPESGSPMPMLDALVQQAFVGIDTITTVANSYDMPKREQTKNMLLKLLFHIKNRYSDMLTPDQRDELDSRVRQLVFEDGKDNANGPNATSTNAAAPSGQVLSERLPFESGAGNSFSKVEIPAKNRMVSPLLDLHADYDENSLPSPTRDSKPPFDVPKPIGYGALPMAPDRPSVLERVEPAKNSSYQSFNDALKAVCYYQQKHGQKSNFASDDLPSPTPSGDGDKSGDKGGDVFGEVSSFSASNKIALPIVNQMPSRPSTVSSNSDSFAGGPPGYAKQIENSVSGSNHLLKATAKSRDPRLKFLNRDTGGVADANRRVNFAEPNPSKDRTMGGGVSINSRKNKAVDEPMVDENALKRSRGVIGNLRDMQPTGRGGWAKDGGNISSYSSDGFQPNQNTRLGNNTTGNHNIRTDSTLASNLNNTTNNSGTSPGIVQAPQTNSAPQTSSAPAVSLPAMLKDIAVNPTMLMQWIQMEQQKMSASEPQQKVTASVGMTSNVTPGMVLPLGNAPKTTEVAAVPSVRPQVPMQSAPMHSQNDTGVIRMKPRDPRRILHSNIVQKNDTVPPVGVEQAKSNGTAPPDSQSSKDHLLNQDQKAEQLQAIALPSLPVTSSARPVTMNANPVSNSQLAATALMPPHGNTKQTSSSVNKADPRLAAGQNESNDDAATSTGPVTAPDAVPPASPYGDVDHLLDGYDDQQKALIQKERARRIKEQHKMFAARKLCLVLDLDHTLLNSAKFIEVDHIHGEILRKKEEQDRERAERHLFCFNHMGMWTKLRPGIWNFLEKASKLYELHLYTMGNKVYATEMAKVLDPTGTLFAGRVISRGDDGDPFDSDERVPKSKDLDGVLGMESAVVIIDDSVRVWPHNKHNLIVVERYTYFPCSRRQFGLPGPSLLEIDRDERPEDGTLASSLAVIERIHKNFFSHPNLNDADVRSILASEQQRILGGCRIVFSRIFPVGEANPHMHPLWQTAEQFGAVCTNQIDDRVTHVVANSLGTDKVNWALSTGRFVXHPGWVEASALLYPACQ

SEQ ID NO: 13355 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEAVALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 13356 - protein, 144 aa, Prochlorococcus marinus str. MIT 9313
MSRSDSSASDSVDWIKLSPEEWQARLTREQYQVARKGGTERAFTGAYWNHKAAGMYCCVCCGAPLFSSATKFDSGTGWPSFSDGVKAGAITTHRDTSHGMERTEINCARCGAHLGHVFNDGPAPTGQRYCVNSASLDFSEEAEV

SEQ ID NO: 13357 - protein, 319 aa, Lycopersicon hirsutum
MGSKYSKATNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYALRLQESVI

SEQ ID NO: 13358 - protein, 496 aa, Schizosaccharomyces pombe
MSEDLFVSINFPNGKSVKQPIGLYINGEWHKSAETWETVDPSIEEVIAKVYLAGEKEIDYAVKSAKEAFKTWKKVPGSEKGELLMKLAELTEKHADTLAAIEAMDSGKPLVSNARGDVDGTIALLRYCAGWADKIYGQVIPTGPEKLAYAKRTPIGVCGQIVPWNYPLNMAGWKIAPALAAGNCIIIKSAETTPLSLLYFATLVEEAGFPKGVVNIISGLGTVAGSYMAKHPGIDKIAFTGSTKVGVIVQQLAASNLKAVTLECGGKSPFLVFEDADLDQAVKWAALGIMYNSGQICTSNSRIYVQDSVYDKFIELFKKHVIQDYIVGMPFDDNTVVGPVVNKTQYNRIKNYIEQGKKEGAKLVLGDEPLPLKQGYFISPTIFADCSENMTIVKEEIFGPVVAISKFKTEDEAIEKANNTTYGLAAMCFTKDLERAHRVSDELEAGMVFINSTENSDIQAPFGGIKMSGIGNELGSNGIEMYTQIKAVHINFNNKL

SEQ ID NO: 13359 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 13360 - protein, 425 aa, Oryza sativa (japonica cultivar-group)
MGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVTVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 13361 - protein, 507 aa, Pichia angusta
MSNPPVFTTSQGCPVSDPFTTQRIPLDSTGYKYAPPIGPLLLQDFKLIDTLSHFDRERIPERVVHAKGAGAYGVFEVTDDITDVCSAKFLDTVGKKTRIFTRFSTVGGEKGSADTARDPRGFATKFYTEDGNLDLVYNNTPIFFIRDPIKFPHFIHTQKRNPATNLKDPNMFWDYLTANDESLHQVMYLFSNRGTPASYRTMNGYSGHTYKWYNSKGEWVYVQVHFIANQGVHNLLDEEAGRLAGEDPDHSTRDLWEAIEKGDYPSWECYIQTMTLEQSKKLPFSVFDLTKVWPHKDFPLRHFGRFTLNENPKNYYAETEQIAFSPSHTVPGMEPSNDPVLQSRLFSYPDTHRHRLGPNYHQIPVNCPLKSGSFNPINRDGPMCVDGNLGGTPNYANAYNCPIQYAVSPKASGNKPDEKYTGEVVPYHWEHTDYDYFQPKMFWKVLGRTPGEQESLVKNVANHVSAADEFIQDRVYEYFSKAEPIIGDLIRKKVQELKRKASSPSKI

SEQ ID NO: 13362 - protein, 370 aa, Arabidopsis thaliana
MATLVDPPNGIRNEGKHYFSMWQTLFEIDTKYMPIKPIGRGAYGVVCSSVNSDTNEKVAIKKIHNVYENRIDALRTLRELKLLRHLRHENVIALKDVMMPIHKMSFKDVYLVYELMDTDLHQIIKSSQRLSNDHCQYFLFQLLRGLKYIHSANILHRDLKPGNLLVNANCDLKICDFGLARASNTKGQFMTEYVVTRWYRAPELLLCCDNYGTSIDVWSVGCIFAELLGRKPIFQGTECLNQLKLIVNIIGSQREEDLEFIVNPKAKRYIRSLPYSPGMSLSRLYPCAHVLAIDLLQKMLVFDPSKRISASEALQHPYMAPLYDPNANPPAQVPIDLDVDEDLREEMIREMIWNEMLHYHPQASTLNTEL

SEQ ID NO: 13363 - protein, 319 aa, Brassica napus
MEICTYFKSQPTWLLVLFSLGSISILRFTLTLLTSLYIYFLRPGKNLRRYGSWAIITGPTDGIGKAFAFQLAQKGLHLVLVARNPDKLKAVSDSIQAKHSTTQIKTVLMDFSGDIDAGVRRIKEAIEGLEVGILINNAGVSYPYAKYFHEVDEELLGNLIKINVEGTTKVTQAVLVNMLKRKRGAIVNMGSGAAALIPSYPFYSVYAGAKTYVDQFSRCLHVEYKKSGIDVQCQVPLYVATKMTKIRRASFLVASPEGYAKAALRFVGYEPRCTPYWPHALMGYVVSALPESVFESFNIKRCLQIRKKGMLKDSSSKKE

SEQ ID NO: 13364 - protein, 432 aa, Glycine max
RVSYVGPPRRNRKALGDIGNLANIRSAVEVKPNRPITRSFGAQLLANAQAAAAAGNNKKQACANVAGPPAVANGGVAVAKRVAPKPGPKKVTVTVKPKPEEVIDIEASPDKKEVLKDKKNEGDANSKKKSQHTLTSVLTARSKAACGITNKPKEQIIAIDASGPTRPLAAVEYIDDIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 13365 - protein, 331 aa, Triticum turgidum
MTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGAKLLRAIAGAGVLSGYDQLQILFFGKKYGSGGA

SEQ ID NO: 13366 - protein, 447 aa, Streptococcus pyogenes MGAS315
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNIGESIMVPRYGAAIADEGLLPAAIAKQNQNGAPLVAILVSGAIAIVLLLTGSFENLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 13367 - protein, 270 aa, Zea mays
MAYAARLVAKVHLAATPQAEPRHLSSFRVGALSRSTTVQRQKFVAKSAISAVESGDTFVGVKQNTRPIIVIDNYDSFTYNLCQYMGEVGANFEVYRNDEITVEEIKKISPRGILISPGPGTPQDSGISLQTVTELGPSIPLFGVCMGLQCIGEAFGGKVVRSPYGVVHGKGSLVHYDEKLDGTLFYDISNPFQAGRYHSLVIEKDSFPHDTLEIVAWTDDGLIMAARHRIYKHIQGVQFHPESIITTEGRLMVNNFIKIIEGYEASNCSP

SEQ ID NO: 13368 - protein, 426 aa, Bifidobacterium longum DJO10A
MYARQILDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAFKACKKYLAK

SEQ ID NO: 13369 - protein, 437 aa, Saccharomyces cerevisiae
MGQGVSSGQDKKKKKGSNQKPKYEPPVQSKFGRKKRKGGPATAEKLPNIYPSTRCKLKLLRMERIKDHLLLEEEFVSNSEILKPFEKKQEEEKKQLEEIRGNPLSIGTLEEIIDDDHAIVTSPTMPDYYVSILSFVDKELLEPGCSVLLHHKTMSIVGVLQDDADPMVSVMKMDKSPTESYSDIGGLESQIQEIKESVELPLTHPELYEEMGIKPPKGVILYGAPGTGKTLLAKAVANQTSATFLRIVGSELIQKYLGDGPRLCRQIFKVAGENAPSIVFIDEIDAIGTKRYDSNSGGEREIQRTMLELLNQLDGFDDRGDVKVIMATNKIETLDPALIRPGRIDRKILFENPDLSTKKKILGIHTSKMNLSEDVNLETLVTTKDDLSGADIQAMCTEAGLLALRERRMQVTAEDFKQAKERVMKNKVEENLEGLYL

SEQ ID NO: 13370 - protein, 505 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFTDVEQAAFAPTNIIPGLDFSPDKMLQGRLFSYGDAQRYRLGVNHWQIPVNQPKGVGIENICPFSRDGQMRVVDNNQGGGTHHYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 13371 - protein, 566 aa, Bacillus cereus ATCC 14579
MFGKTASEALVDLLIDWGVEHIYGMPGDSINSIIEALRKKQDKIKFIQVRHEEAGALAAAAYAKLTGKLGVCMAIAGPGAIHLLNGLYDAKLDKAPVLAISGQVETDLLGTDFFQEVNLERMFDDVAVYNQRIMSAEQLPAVVNQAIRMAYTKKGVSVLTIPDDVPKFEVKSGARVTNTSFTLPDLFPQEEDLDAAKLAITEAKKPVILAGKGTKHARESLLALAEHIGAPIVLTLPAKGIIPDEHPLCIGGLGLIGTKPSYEAMKHADTLIMVGTSYPFTGFLPEKAKTIHIDTDPAQIGKRYATDIGLAGDADKTLRWLIENVEEHTDHSFLEHHQEMMKKWEEKLHDQEEDSSIPIKPQRVMHALQQVAHDDAILSVDVGNVTVWTARHFRMTNQQFVISSWLATLGCGLPGALAGKIAFPDKQVFAVCGDGGFGMTMNDFVTAVKYKLPIVVVVLNNNKIAMIKFEQEVMGNIEFETDLTNPDFAKYAEACGGIGYRVENLDELLPAFQNAVKQNKPCIIDVVVDANEAPMPAKITFGQAAGYTKHMIKELFEEGKIDLPPL

SEQ ID NO: 13372 - protein, 252 aa, Zea mays
PRVRAEQTLQDELQRKGEETIQQIEKAQEIAKAELAAAVAKEKASQIEQIGEANLNIDALCMAFYARSEEARQSHSVHKLALGTLALEHALSSGSPIRSEVGLLRKSVEGIDKDSLLELAFSSLPEDVLDYGSDTRMGLKQQFNSLKETIRHLSLLPAGGGGILAHAVARVASSIKIKGDNSGDGIESLINKVESMIVNGDLSTAADALEQGLHGTEAEEIATEWVKQARKRALAEQTLALLRACASSTTFS

SEQ ID NO: 13373 - protein, 478 aa, Emericella nidulans
MSTYPVAYNGTGVNGGDSLREDLNIYYSSGDIAWVITSTALVLLMIPGVGFFYSGLARRKSALSLIWLSLMSIGVVSFQWFFWGYSLAFSHTAGKYIGNLDNFGFKGVLGAPSVGSTKVPDLLFAVFQGMFAAITVALAVGAVAERGRMLPCMVFVFIWSTIIYDPVACWTWNASGWVFQLGGLDFAGGTPVHIVSGTTALAYSLMLGKRRGHGTHELNYRPHNVTHVVIGTVFLWVGWFGFNAGSALSANLRAVMAAVVTNLAASVGGVTWCLLDYRLERKWSTVGFCSGVISGLVAITPGSGFVTPWAAFIFGVVGAAACNFATKVKYLIRVDDALDIFAVHGIGGLVGNLLTGLFAADYIAHLDGSTEIDGGWINHNYIQLGYQLADSVTGMAYSFFGSCIILFIINMIPGLSLRVPEEDEVLGIDDAEIGEFAYDYVELTRDVINGTTEPMDGASKRSTTPTGPVEPSPAELKA

SEQ ID NO: 13374 - protein, 77 aa, Glycine max
  unsure (1)..(77): unsure at all Xaa locations
TTVNRAGAGMVAPFTGLKSMAGLLTKKTNXDITCIATNRGRVQCMHVWPRVXQEELETLSYLTTMDDTQYQTEAEYL

SEQ ID NO: 13375 - protein, 90 aa, Synechocystis sp. WH 8501
MTLPAPDTPLYNHPLPMIEQWLSGLGCQQDQQNLNCWTVTKPNWKAQLNLDVEEIIVCYLKAGADGSDITRAFKYSLSREDVEAAVFSEP

SEQ ID NO: 13376 - protein, 426 aa, Clostridium tetani E88
MEVLSNITHEITKIITWIVFVISMYYLIISFFGIWIKKDEEKCKPKNKFALVVAAHNEEIVIENIVHSLKKLDYPEELYDIFVIADNCTDRTAERARKEGAIVYERFNKEKRGKGYALEWMFSKIFKMTKGHNAVVVFDADNLVHKNFLNEMNKKMLRGDKVIQGYLDSKNPEDTWITGSYSISFWTSNRMFQLSRSNLGLSNQLGGTGFCIDIDVLKEIGWGATCLTEDLEFSCKLVLNGYKVSWAHKAIIYDEKPLTLKQSWSQRRRWMQGFADVSHRYFFKLIKKSVKDLDFKALDCALYSIQPIIILLFGFSMAMGTINYINKALNMILNIDEVLSMYVMNFNMITFSAIMISIFQFIYTPFILILESKLDLKIFFYYIIYPIYAITWIPISIQGILRKDDKEWSHTTHTRNVKINDLKKVN

SEQ ID NO: 13377 - protein, 567 aa, Triticum aestivum
  unsure (1)..(567): unsure at all Xaa locations
IVPASAARSSWLLPPRGGPPPRSPPAACSPRPAASPAAVPSALRRADGARGLLPGTPSGVRHCGSSRRSPFRLLSKWATITAPYQRQIPVAAASGKTLPDCGTRRTGEVIARVAEXGDAEDVDRAAXAARKAFDEGPWPRMTAYERSRILLRFADLIEKHNDDIAALETWDNGKPYEQAAHIEVPMLVRLMRYYAGWTDKIHGLIVPADGPHHVQVLHEPIGVVGQIIPCDFPHLMYRAKILPPLACGDTILLKTAEQTPLSALYVSKLLHEAGLPEGVLNIVSGFGPTAGAALASHMDVDKIAFTGSTATGXVILELSARSNLKRVRLGRXGKTPFIVMDDVHIEPAPESSHISLCFIHGHSCGAGCRTFVYMSVYXERFLRKSKARALKRXVVGDXPFRKGVEQGPQIDDEQFKKILRYIKSGVDSGATLXTGGDKLGDKGYYIQPTIFSDVQDGMKIAQEEIFGPVQSIFKFNDLNEVIKRANASQYGLAAGVFTNNLXTPANTLTRALRAGTVWVNCFDIFDAAIPFGGYKMSGIGREKGIDSLKNYLQVKAVVTALKNPAWL

SEQ ID NO: 13378 - protein, 396 aa, Sesamum indicum
MALKLNAINFQSPKCPSFALPPVASVRSPKFFVASTLRSGSKEVETVKRPFNPPREVHVQVTHSMPPQKIEIFKALEDWADNNILVHLKPVEKCWQPQDFLPDPSSDGFDDQVKELRERAKEIPDDYFVVLVGDMITEEALPTYQTMLNTLDGVRDETGASPTSWAIWTRAWTAEENRHGDLLNKYLYLSGRVDMRPNGKTFRYLIGSGMDPRTENSPYLGFIYTSFQERATFISHGNTARLAREHGDLKLAQICGTIAADEKRHETAYTKIVEKLFEIDPNDTVLAFADMMRKKISMPAHLMYDGRDDNLFDHFSSVAQRLGVYTAKDYADILEHLVARWKVANLTGLSADGQKAQDYVCGLPPRIRRLEERAQGRAKQAPKIPFSWVHDREVQL

SEQ ID NO: 13379 - protein, 94 aa, Zea mays; identical to SEQ ID NO: 12855

SEQ ID NO: 13380 - protein, 194 aa, Acinetobacter calcoaceticus
MLLMIDNYDSFTYNIVQYFGELNQDVKVVRNDQVTLEDIERWQPKYLVVGPGPCSPTEAGISIPAIHHFAGRIPLLGVCLGHQAIGQAFGGNIIRAKTVMHGRLSDMYHTDKGIFSNLPSPFSATRYHSLVIEQESLPECLEVTCWTNQNDGSIEEIMGVKHKTLPVEGVQFHPESILSQHGHQIFKNFLEIYA

SEQ ID NO: 13381 - protein, 66 aa, Oryza sativa
  unsure (1)..(66): unsure at all Xaa locations
MMQLGCYCGIQSCSGIFKSGYPXRRGRAILQAVTHYSDPKILAEVSSGIGQAMGGINLSHPNVDRF

SEQ ID NO: 13382 - protein, 405 aa, Methanosarcina barkeri
MLNTGSTGFMLLATSLVMLMTPGLAFFYGGLSCKRNILGIMMQSFVSMGATTVLWFFIGYSLCFSGGEGAIIGNLDKMFLHGITPTTIIKDMGFPEIVFVAYQMMFAIITPALITGAFANRVTFKAYLIFLVLWQLFVYYPFVHMVWGGGLLAQMGVLDFAGGIVVHATAGFAALASVFYVGSRKYNKITKPNNIPLMAIGTALLWFGWYGFNAGSELNVDGITSLAFLNSDIAASFAAITWMIIEWYKERKPKFVGLMTGAVAGLATITPAAGLVALPVAAIMGILGSVVCYFAVHLKNKMEWDDALDVWGVHGIGGVTGTILLGVFASTAINPVGADGLLYGGTAFFIKEVVVVAATSVYAFVFTYIMLMLINTITPVKVTDEEQLIGLDISMHGECAYDTIH

SEQ ID NO: 13383 - protein, 274 aa, Dechloromonas sp. RCB
MKPEISIEFFPPQTPEGIEKLRTVRAELAKLNPHFFSVTYGAGGSTRERTFAVVKEIAAEGFDAAPHLSCIGSTRESIREILAEYKSAGIKRTVALRGDLPSGMAEAGEFRYANELVEFIRAETGDWFSIEVAAYPEWHPQARSPKDDLEAFARKVKAGANSAITQYFYNADAYFHFVDEAKALGVDVPIIPGIMPIAGFTKLARFSDACGADIPRWMRKKFESFGDDADSIRAFGLDVVTELCERLLKGGAPGLHFYAMNQSALTTEICRRLG

SEQ ID NO: 13384 - protein, 92 aa, Triticum aestivum
MAGKDRVLMCAALIVLLLLVETTAPSGQAHAVDCGSACSYRCSKSSRPNLCNRACNTCCRRCDCVPPGTAGNEEVCPCYANMTTHNGRHKCP

SEQ ID NO: 13385 - protein, 431 aa, Rhodospirillum rubrum
MMRAFTFLPAALVALLAPALAYAQDAAPTLDSGNTAWMLTSTALVLLMTIPGLALFYAGMVRKKNVLATMMQSFIITALVSVVWMVAGYSIAFGTGNAYFGDFSKFLLSDISIDSLNGTFPETVFVVFQMTFAIITPALITGAFAERMKFSAMLWFIGLWVLIVYAPICHWVWSSSGFLFNAGVLDYAGGTVVHINAGVAGLVCALVLRRRAGFGSENMAPYNLSLAVIGAALLWVGWFGFNAGSAVAADGRAGMAMLATQLGAAGATLSWIAAEWLVRGKPSVLGAVSGAVAGLVAITPASGFVLPGGALVIGLVAGVVCFWGATWLKKTLGYDDSLDAFGVHGIGGLVGALLTGVFAAQSVGGEAAVGLLEGNPGQVLTQAWGCLATIVWTAVASYVILKVIDLAIGLRVSPEQESEGLDISLHGERLQ

SEQ ID NO: 13386 - protein, 177 aa, Streptococcus sanguinis
TSIMFDGSHLPVEENLEKAKEVVEKAHAKGISVEAEVGTIGGEEDGIIGRGELAPIEDAKAMVETGIDFLAAGIGNIHGPYPENWEGLDLDHLKKLTEAVPGFPIVLHGGSGIPDDQIRAAIKLGVAKVNVNTECQIAFSNATRAFARAYDANEAEYDKKKLFDPRKFLADGVKAIQ

SEQ ID NO: 13387 - protein, 366 aa, Oceanobacillus iheyensis HTE831
MEKHIILLPGDGIGREIIDSAKQVLTAIASEYNHRFTFEEHAIGGSAIDEYGTPLPDKTVDACSKADAILLGAVGGPKWDANPSHLRPEKGLLGIRKQLGLFANLRPVKTISSLLYASPLKEEIVSQADMLIIRELTGGIYFGTPSERTTNGVVDTLQYSREEIERIVERGFEAARIRKKHLTSVDKANVLESSKLWREIVEEKSKDYPDVAVNHLLVDAAAMKLVTQPSFFDVIVTENLFGDILSDEASVLTGSLGMLPSASLRADGLGLYEPVHGSAPDIAGKGIANPLAMILSAALMLEHSFGLVDEAKEIERAVNDCLLQGFHTADIHIPGGVQVGTKQMTDAVLENVTTKSISDSICSSYV

SEQ ID NO: 13388 - protein, 369 aa, Zea mays
  unsure (1)..(369): unsure at all Xaa locations
MGPRHKFRLSDMIPNAWFFKLRDMRARGGGGAAASPRVAAHAASRTPPTTPRHGHGAPAAAAAAPWLPHRASHYYTPRAGDLVLGSPLRPKASDTRFPPLQLSPPRRSRRRHRRRSAVKLPPPPSASSSGGVASSPASTACRCGXRRPELVVAEAPDTPPCRRDVFVGYSSDDDEYVKKPTAAVRAHDKLYAQVITSATDIVIDLRTKRRPEKTLPPIMTKTRPAKPDVFRLEDKHVDVLAHAARRASPVPEQGKLRPRRSVSSARRLKTRANTPRLASSMKCKSPTTATPPTKPPPLAESFAVVKSSRDPRRDFRESMEEMIVENGIRTATDLEDLLACYLALNAAEYHDLIVEVFEHIWVTLSDAKL

SEQ ID NO: 13389 - protein, 456 aa, Zonaria diesingiana
YNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVIVERERLDKFGRPLLGATVKPKLGLSGKNYGRVVYEGLRGGLDFLKDDENINSQPFMRWKERFLYCMEGVNRSAAATGEVKGSYLNVTAATIEQMYERAEYAYSLGTVIVMIDLVIGYTAIQTMAIWARKAQMILHLHRAGNSTYARQKNHGINFRVICKWMRMAGVDHIHAGTVVGKLEGDPLMVRGFYNTLLLTHLKVNLAEGLFFDMDWASLRKCVPVASGGIHCGQMHQLLYYLGDDVVLQFGGGTIGHPDGIQSGATANRVALEAMVLARNEGRDYVSEGPEILRTAAATCAPLKTALDLWKDITFEYTSTDTPDFVEVATGSN

SEQ ID NO: 13390 - protein, 363 aa, Lycopersicon esculentum
MESPRVEESYDKMSELKAFDDTKAGVKGLVDSGITKVPQIFVLPPKDRAKKCETHFVFPVIDLQGIDEDPIKHKEIVDKVRDASEKWGFFQVVNHGIPTSVLDRTLQGTRQFFEQDNEVKKQYYTRDTAKKVVYTSNLDLYKSSVPAASWRDTIFCYMAPNPPSLQEFPTPCGESLIDFSKDVKKLGFTLLELLSEGLGLDRSYLKDYMDCFHLFCSCNYYPPCPQPELTMGTIQHTDIGFVTILLQDDMGGLQVLHQNHWVDVPPTPGSLVVNIGDFLQLLSNDKYLSVEHRAISNNVGSRMSITCFFGESPYQSSKLYGPITELLSEDNPPKYRATTVKDHTSYLHNRGLDGTSALSRYKI

SEQ ID NO: 13391 - protein, 378 aa, ASPERGILLUS NIDULANS FGSC A4
MGLRVKALAVAALATLSQASPVLYTREDTTSNTTYAFTNSNGLNFTQMNTTLPNVTIFATGGTIAGSAASNTATTGYQAGALGIQTLIDAVPEMLSVANIAGVQISNVGSPDVTSTILLEMAHRLNKVVCEDPSMAGAVVTHGTDTLEETAFFLDATVNCGKPIVIVGAMRPATAISADGPYNLLQAVTVASTKEARNRGAMVVMNDRIASAYYVSKTNANTMDTFKAVEMGYLGAIISNTPFFYYPAVQPSGKTTVDVSNVTSIPRVDILYSFQDMTNDTLYSSIENGAKGVVIAGSGAGSVDTAFSTAIDDIISNQGVPIVQSTRTGNGEVPYSAEGGISSGFLNPAKSRILLGLLLAQGGKGTEEIRAVFGKVAV

SEQ ID NO: 13392 - protein, 149 aa, Pectobacterium carotovorum subsp. carotovorum
GMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAGR

SEQ ID NO: 13393 - protein, 409 aa, Raphanus raphanistrum
  unsure (1)..(409): unsure at all Xaa locations
LAIPXWDQPMRLPGYMSRLPQPPXVSQLRQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKILENRAEELKLDFGVWRSELKEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 13394 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 13395 - protein, 126 aa, Glycine max
  unsure (1)..(126): unsure at all Xaa locations
SSMICSPAGATVXRGGGGMVAPFAXLXSMGGLPTGETRADITCVASXGGRAPCFFFWPPXGAKKGEILSYLPEVGDAQLAKEVESLLRKGWIPCLEFELEPGFVSRAPGRAPRIYDGRSRSLGKLA

SEQ ID NO: 13396 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 13397 - protein, 450 aa, Zea mays
WCRVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRTYMESMVPLPGVYDPDFIAANQGSRANNVIKGTKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENILRACVGLAPENNMILEYK

SEQ ID NO: 13398 - protein, 122 aa, Desulfovibrio vulgaris subsp. vulgaris (strain Hildenborough)
MSKHILIVDDSKTVRNLVAFIMKKEGFKVTTAEDGLDGLEKLYSSEGVDLIISDVNMPRMDGFTFIKTVREQDTYRNLPIVVLSTEGQEKDIQMGMSLGANLYMVKPAQPEKMVKNIKMLLG

SEQ ID NO: 13399 - protein, 360 aa, Triticum aestivum
  unsure (1)..(360): unsure at all Xaa locations
GPCSRPLPLSSLAPFPRSAALTWRSVVAVVGSGARLVRGARLMGCGQTYLQSASVRIEEMRVKRRDTEQWMAHRLLPENLKGRILRHEQYRWQETRGVDEEGLLMNLPKDLRREIKRHLCLSLLMRVPMFENMDEQLLDAMCDRLKPMLYTEDSCIIREGDPVNEMLFVMRGYLESMTTNGGQSGFFNSNVLKGGDFCGEELLTWALDPAAVSNLPSSTRTVKTLSEVEAFVLRADDLKFVATQFRKLHSKQLQHTFRFYSQQWRTWAACFIQAAWHRYCRKKLEDSLFEKEKRLQAAIVXDDSTKLSLGAALYAXSRFAGNMMXRILRRNATRKARLQDRVPARLLQKPAEPNFFAVGE

SEQ ID NO: 13400 - protein, 200 aa, Pseudomonas aeruginosa UCBPP-PA14
MRITLLDNFDSFTYNLVEQFCLLGAEVRVMRNDTPLPTIQAALLADGCELLVLSPGPGRPEDAGCMLELLAWARGRLPVLGVCLGHQALALAAGGAVGEARKPLHGKSTSLRFDQHHPLFDGIADLRVARYHSLVVSRLPEGFDCLADADGEIMAMADPRNRQLGLQFHPESILTTHGQRLLENALLWCGALAVRERLRA

SEQ ID NO: 13401 - protein, 538 aa, Oryza sativa (japonica cultivar-group)
MADDFLSSQPQPWPPLLQLSAAVLFFLLPLLYLLFLRGSNGEVRGRQGNSASAPSLPGPCRQLPVLGNLLQIGSRPHRYFQAVSRRYGPVVQVQLGGVRTVVVHSPEAAEDVLRTNDVHCCSRPPSPGPRMLSYNYLDVAFAPYSDYWREMRKLFVVELTSVSRVRSFAYARAAEVARLVDTLAASPPGVPVDLSCALYQLLDGIIGTVAFGKGYGAAQWSTERAVFQDVLSELLLVLGSFSFEDFFPSSALARWADALAGVERRRRRIFRQVDGFLDSVIDKHLEPERLSAGVQEDMVDALVKMWREQQDRPSGVLTREHIKAILMNTFAGGIDTTAITAIWIMSEIMRNPRVMQKARAEVRNTVKNKPLVDEEDSQNLKYLEMIIKENFRLHPPGNLLVPRQTMQPCLIGGYNVPSGTRVFINIWAMGRGPMIWDNPEEFYPERFEDRNMDFRGSNFELVPFGSGRRICPGVAMAVTSLELVVANLLYCFDWKLPKGMKEEDIDMEEIGQISFRRKVELFIVPVKHEQYQLMGHIN

SEQ ID NO: 13402 - protein, 725 aa, Aspergillus oryzae
MRALSLASLIGIASAACPYMTGELERRDTGTDDATAATEEFLSQYYMADNDTFLTSDVGGPIEDQNSLQVGDRGPTLLEDFIFRQKIQRFDHERVPERAVHARGVGAHGVFTSYGDYSNITAASFLGAEGKETPVFVRFSTVAGSRGSSDLARDVHGFATRFYTDEGNFDIVGNNIPVFFIQDAILFPDLIHAVKPRGDNEIPQAATAHDSAWDFFSQQPSSLHTLLWAMSGHGIPRSLRHVDGFGIHTFRFVTDNGDSKLVKFHWKSLQGKASMVWEEAQQVSGKNPDFMRQDLFEAIEAGRYPEWELGVQIMDEEDQLKFGFDLFDPTKIVPEEYVPITKLGKMTLNRNPRNYFAETEQVMFQPGHIVRGVDFTEDPLLQGRLFSYLDTQLNRHGGPNFEQLPINQPRVPVHNNNRDGAGQMFIPLNPNAYSPNTLNKGSPKQANQTVGKGFFTAPGRESTGRFTRAVSPSFEDVWSQPRLFYNSLTPAEQQFVVDAIRFENSNVKSSVVRNNVIIQLNRVSNDLARRVARAIGVEEPEADPTYYHNNKTTDVGTFGQKLKKLDGLKVGFLASVETPASIEAASELSKQLSEDGVDVVVVAERLSDGVDQTYSGSDAIQFDAVIVAPGAEGLFSTFSFTAPSNATSSSTLFPAGRPLQIVIDGFRFGKPVGAVGSAATALKNAGIQTSRDGVYVDKSVTSGFVDGIKDGLRTFKFLDRFKLDH

SEQ ID NO: 13403 - protein, 488 aa, Listeria monocytogenes EGD-e
MADVRKLKNYIDGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 13404 - protein, 447 aa, Zea mays
MEMHADVDGCSVPLAVLLKRELCNQKVERPDILFGEANKSKKGEDFTLLVPRCHRTPGGSGGGENAGDDDTISVFAIFDGHNGSAAAIYTRENLISSVLAAIPPNLTSEEWKAALPRALVAGFVKTDKDFQGKGIINGMPAARSGTTVTFVIIDGWVVTVASVGDSRCILESAEGSIYFLSADHRLDANEEEVERVTASGGEVGRINIAGGAGIGPLRCWPGGLCLSRSIGDIDVGEFIVPVPHVKQVKLSNAGGRLVIASDGVWDALHFQEALNYTRGLPAEAAANRIVKEAVTSKGLRDDTTCIVVDILPPEKLSPPLKRPGKGVIKALFRRRPSDEMSEDQMDRGCLETDVVEEIYEEGSAMLARRLNINYPEGNMFKLHDCAVCQLEMKPGEGTSVHGNMPKHSRVDPWGGPFLCSSCQLKKEAMEGKLHSRNSQSAVQPVPK

SEQ ID NO: 13405 - protein, 338 aa, Zea mays
  unsure (1)..(338): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYXSTRVVDLIRHMNSTN

SEQ ID NO: 13406 - protein, 634 aa, Mesembryanthemum crystallinum
MAKEEEFINNRRAGKRPKLTQKTKDQERESICNGHNNQWDLEENQYLHNNNNNNNNKFYYPQPVLAPSSIVVCDALEADYPIIYVNTSFEIFTGYRANEALGRNCRFLQYMDPHAQRRHPLVDPVMVSEMRRCLEEAVQFEGELLNFKKDGTPLVNRLRLQPIHADDGTITHVIGIQIFSEAKVNLNHVSYPVYKEKCDHQFDCADDDHPTKDGGDFCGILQLSDEVLAHNILSRLTPRDVASIGSVCRRIYQLTKNELVRKMVCQNLWGREVIGNLELMTKKLGWVRLARELTTLEAVRWRKFTVGGAVEPSRCNFSACAAGNRLVLFGGEGVDMQPMDDTFVLNLDAEHPEWRRVSVKSSPPGRWGHTLSCLNGSWLVVFGGCGKQGLLNDVFVIDLDAKQPTWTEIPGGSTPPVPRSWHSSCTIDGSKLVVSGGCSDSGVLLSDTHLLDLMTNTPAWREIPTSWAPPSRLGHSLTVYGKTNIFMFGGLVKSGQLRLRSGEAYTIDIGNDNPRWRQLECGAHAGGGTQGGVVPPPRLDHVAVSMPCGRIIIFGGSIAGLHSSSQIFLIDPSEEKPSWRIINVPGQPPKFAWGHSTCVVGGTRVLVLGGHTGEEWILNELHELCLASKHDSDF

SEQ ID NO: 13407 - protein, 486 aa, Pseudomonas aeruginosa PAO1
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 13408 - protein, 412 aa, Bacillus anthracis str. A2012
MSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 13409 - protein, 264 aa, Zea mays; identical to SEQ ID NO: 12042

SEQ ID NO: 13410 - protein, 728 aa, Candida albicans
MYYSEEIGLPKTDISRWRLRSDALGRETWHYLSQSECESEPQSTFVQWLLESPDFPSPPSSDIHTSGEAARKGADFLKLLQLDNGIFPCQYKGPMFMTIGYVTANYYSKTEIPEPYRVEMIRYIVNTAHPVDGGWGLHSVDKSTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTEYLCIAPVSFAFNMVVTCHYEGSESENFKKLQNRMNDVLFHGPQGMTVMGTNGVQVWDAAFMVQYFFMTGLVDDPKYHDMIRKSYLFLVRSQFTENCVDGSFRDRRKGAWPFSTKEQGYTVSDCTAEAMKAIIMVRNHASFADIRDEIKDENLFDAVEVLLQIQNVGEWEYGSFSTYEGIKAPLLLEKLNPAEVFNNIMVEYPYVECTDSSVLGLTYFAKYYPDYKPELIQKTISSAIQYILDSQDNIDGSWYQCWGICYTYASMFALEALHTVGLDYESSSAVKKGCDFLISKQLPDGGWSESMKGCETHSYVNGENSLVVQSAWALIGLILGNYPDEEPIKRGIQFLMKRQLPTGEWKYEDIEGVFNHSCAIEYPSYRFLFPIKALGLYKNKYGDKVLV

SEQ ID NO: 13411 - protein, 364 aa, Prochlorococcus marinus subsp. marinus str. CCMP1375
MMQSTNVTNQETTNNISLRSAHAERVSKLSTQEPAQVNRETGLKIFRDMTLGRRFEDKCAEMYYRGKMFGFVHLYNGQEAVSSGVICAMQQKHDWFCSTYRDHVHALSAGVPAREVMSELFGKESGCSKGRGGSMHLFSKEHHLLGGYAFIGEGIPVALGSAFTSRYKKEVFNEKGSNSVTAAFFGDGTCNNGQFYECLNMAQLWKLPILFVVENNKWAIGMAHDRATSDPEIWRKANAFGMKGEEVDGMDVLAVRGAAQRAIERARAGEGPTLLECLTYRFRGHSLADPDELRSAEEKDFWASRDPLKLLEKNLTEKDLVSSKELRAIEKEIDQEVADAVEFAIGSADPKPEELTKYIWAEDI

SEQ ID NO: 13412 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEERIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 13413 - protein, 467 aa, Wigglesworthia glossinidia endosymbiont of Glossina brevipalpis
MSINEIINIIEKNNIKFIDFRFTDMVGKEQHITVPFLKKEKINKILKNGKIFDGSSILGWKKIQNSDVLLIPDLTTAVLDPFYNDSTLIIKCDIFESNKSESYNKDPRSIAKNAEKYLQYSKIGDKMYFGPELEFFLFDDIRFYTAIHGSQVIINDIESSWNSGKYYSQGNKGYRPSVKSGYLPVPPVDSSQNIRSSMCLFMEKMGIEVEAHHHEVATSGQNEISTKYNTLTKKADEVQIYKYIVHNTAYFFKKTATFMPKPIRGDNGSGMHCHISIEKEGKNIFFGKEYGNLSKYALFSIGGIIKHAKSINAFANPTTNSYKRLIPGFEAPVSLSYSLNNRSAAIRIPTFNDDKSCRFEIRFPDSSSNPYLLFSAILMASIDGINNKIFPGNPIEKNLYKFKEKNLNKMSSSLEESIYHLDKDREFLTKNNVFTNDFIDSYIELKQKEINIVKSTPHPVEFELYYM

SEQ ID NO: 13414 - protein, 461 aa, Nannochloropsis oculata
GYWDANYTIKDTDVLALFRITPQPGVDPIEAAAAIAGESSTATWTVVWTDLLTACDVYRAKAYKVDSVPGTSDQYFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNITAATMEEMYERAEFAKLVGSVIIMIDLVIGYTAIQSMAIWSRKNDMILHLHRAGNSAYARQKNHGINFRVICKWMRMAGVDHIHAGTVVGKLEGDPLMVKGFYNVLLQTTLDINLPQGIFFEQDWASLRKTLPVASGGIHCGQMHQLLNYLGEDCVLQFGGGTIGHPDGIASGATANRVAMESVLLAKYEGKDYINEGPKILRAAAETCAPLRSALDLWKDIAFNYTSTDTADYIETATKQ

SEQ ID NO: 13415 - protein, 368 aa, Zea mays
CAVAAPCACCRQSLGLVKPMEEMLMAASAGAANPSQGSNPNPPPPAAPLTGAGSTERRARPQKEKALNCPRCNSTNTKFCYYNNYSLQQPRYFCKTCRRYWTEGGSLRSVPVGGGSRKNKRSSSSSSSSSSSAAAASASTSSSATSSSMASTLGAASKSPELAHEGAHDDLNLAFPHHGGQHAAEFPAFPSLQSSNDMCDPGGGMTSNGRGGGAGPAVGALSATELWRSSGCYMPLQMPGDYTAAGFALGEFRTPLLPDAHGPGSSGAAAAAGYGCSAGLPQGVPDNAGRLLFPFEDLKPPVSPGGGGVAGGGASATGGAGDGNSSHDQFDHNKEQGGGGSPGAGAGHDTAGFWSRVYNFGRKFPKFS

SEQ ID NO: 13416 - protein, 1401 aa, Schizosaccharomyces pombe
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 13417 - protein, 563 aa, Yersinia enterocolitica (type 0:8)
MHHSTPLITTIVGGLVLAFLLGSLAHRLRSSPLVGYLAAGVLAGPFTPGFVADTSLAPELAEIGVILLMFGVGLHFSLKDLLAVKAIAIPGAVAQIAVATLLGMGLSHLLGWDLMTGFVFGLCLSTASTVVLLRALEERQLIDSQRGQIAIGRSIVEDLAMVLTLVLLPAFAGVMGNETTSLSQLFTELAITIGKVIAFITLMIVVGRRLVPWILAKTASTGSRELFTLAVLVLALGIAYGAVGLFDVSFALGAFFAGMVLNESELSHRAAQDTLPLRDAFAVLFFVSVGMLFDPMILLREPLAVLASLAIIIFGKSAAAFILVRMFGHSNVYSTHHFCPWRKSVNLPFILAGLGISLGLMSEHGRNLVLAGAILSIMLNPLLFTLLDRYLAKNETMEDLILEEAVEEEKQIPGRFVQSCTVSRLWSGGSLLGAKLHAEGIPLVVIENSRPRVEALREQGINAVLGNAASADIMSLARLDCALVIILTIPNGYEAGEIVASARIKRPDLEIIARAHYDDEVVYISVRGANQVVMGEREIANSMLNMLKIETLTEEDKRPLCPI

SEQ ID NO: 13418 - protein, 506 aa, Caulobacter crescentus CB15
MTKPEFIESLSRPPFKARYDNFIGGQWVAPADGRYFDNSSPIHGRKICEIARSQAIDIERALDAAHAAKAGWARTSAADRSRILLRIADRMEENLAALATAETWDNGKPIRETLAADIPLAIDHFRYFAGCLRSQEGSISEIDHDTIAYHFHEPLGVVGQIIPWNFPLLMACWKLAPALAAGNCVVLKPAEQTPASIMVWAEMIGDLLPAGVLNIVNGFGLEAGKPLASSPRIAKIAFTGETSTGRLIMQYAAQNLIPVTLELGGKSPNIFFDDVAREDDDYLDKALEGFTMFALNQGEVCTCPSRALVQESIYEKFMERALKRVNAVVQGSPLDPATMIGAQASEEQLNKILGYMDIGRNEGAKLLAGGQRKILPGQLADGYYVEPTVFEGHNKMRIFQEEIFGPVLAVTTFKTEEEALEIANDTAFGLGAGVWSRDANRCYRFGRGIEAGRVWTNCYHAYPAHAAFGGYKQSGVGRETHKMMLDHYQQTKNMLVSYSPKALGFF

SEQ ID NO: 13419 - protein, 506 aa, Petunia x hybrida
MMLLTELGAATSIFLIAHIIISTLISKTTGRHLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTYERKGKPDFLDVVMENGDNSEGERLSTTNIKALLLNLFTAGTDTSSSAIEWALAEMMKNPAILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLVHSFDWKLPSEVIELNMEEAFGLALQKAVPLEAMVTPRLQLDVYVP

SEQ ID NO: 13420 - protein, 392 aa, Zea mays
MAAAALLRRLPAARAQAQAPAFMAARPISDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLANAAELKNMEKEIRKQVDDAIAKAKESSMPDTSELFTNVYKKGFGVESFGPDRKEMRASLP

SEQ ID NO: 13421 - protein, 453 aa, Thermobifida fusca
MNRQQEFVLRTLEERDIRFVRLWFTDVLGYLKSVAVAPAELEAAFTEGIGFDGSAIEGFARVYESDMLAQPDPTTFQVLPWRNEPHGAARMFCNILLPDGSPSYADPRNVLKRQLSRASDLGFTFYTHPEIEFYLLKKKPERGELPEPSDEGGYFDHTPHSLARDFRRNAIMMLEEMGISVEFSHHEGGPGQQEIDLRYADALTTADNIMTFRMVMKEVAIEQGVYATFMPKPFTEHPGSGMHTHMSLFEGDRNAFYEAGAEYQLSKIGRGFIAGLLRHAAEITAVCNQFVNSYKRLWGNAAASAGAGGEAPAYICWGHNNRSALVRVPMYKPRKSNSARIEFRALDSACNPYLAFTVILAAGLKGIEEGYELPPGASDDVWALTDAERRALGIMPLPQSLDEALRVMERSELVAEALGEHVFDFFLRNKKAEWEDYRRQVTPYELERYLPTL

SEQ ID NO: 13422 - protein, 338 aa, Mycobacterium tuberculosis H37Rv
MSAKLTDLQLLHELEPVVEKYLNRHLSMHKPWNPHDYIPWSDGKNYYALGGQDWDPDQSKLSDVAQVAMVQNLVTEDNLPSYHREIAMNMGMDGAWGQWVNRWTAEENRHGIALRDYLVVTRSVDPVELEKLRLEVVNRGFSPGQNHQGHYFAESLTDSVLYVSFQELATRISHRNTGKACNDPVADQLMAKISADENLHMIFYRDVSEAAFDLVPNQAMKSLHLILSHFQMPGFQVPEFRRKAVVIAVGGVYDPRIHLDEVVMPVLKKWRIFEREDFTGEGAKLRDELALVIKDLELACDKFEVSKQRQLDREARTGKKVSAHELHKTAGKLAMSRR

SEQ ID NO: 13423 - protein, 228 aa, Zea mays
MPLWGAAASAAPAAEGDAARAPSGSGGGVKVIRSLLPTRRRLRLDPPAKLYFPYEPGKQVRSAVRIKNISKSHVAFKFQTTAPKSCFMRPPGGVLAPGESIIATVFKFVEHPENNEKPMDKCKVKFKIVSLKVKGPVEYVPELFDEQKDQVAVEQILRVVFLDAERPSPQMDKLKRQLAEAEAALEARKKPPEDNGPRIVGEGLVIDEWKERRERYLARQQIEGVDSV

SEQ ID NO: 13424 - protein, 192 aa, Triticum aestivum
  unsure (1)..(192): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVXPVPAFNVINGGSHAGNKLAMPEFMILSTGAASFKEAMEKWG

SEQ ID NO: 13425 - protein, 123 aa, Zea mays
SLRLRIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 13426 - protein, 256 aa, Triticum aestivum
  unsure (1)..(256): unsure at all Xaa locations
MGRKFFVGGNWKCNGTVEQVESIVNTLNAGQIASTDVVEVVVXSPPYVFLPTVKAKLRPEIQVAAXQNCWVKKGGAFTGEVSAEMLVNLRRSLGSFLGHSERRSLMGESSEFVGEKVAYALAQGLXKVIACVGETLEQREAGSTMXIVAEQTKAITGKIKDWTNVVVAYEPMWAICTGKVXTPAQAQEXHCNLRELLKDHVKPXEVLHPHRSFIGGSGTGAXCKDWAGQPQXQGFLCWGSFLLNLGLYDIINGPHR

SEQ ID NO: 13427 - protein, 164 aa, Vibrio cholerae O139
VTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRLPVIGGHSGVTILPLLSQVEGVSFTDEEVAA

SEQ ID NO: 13428 - protein, 372 aa, Oryza sativa (japonica cultivar-group)
MTGSARSVVALLFLLVGSAARADSAVTDGLLPNGNFEDGPDKSQLNGTVVTGRYAILNWEISGFVEYIESGHREQDMILAVPEGARAVRLGNDATIRQRLSVTRRAYYSITFSAARTCAQKEKLNMSVTPEFGVLPIQTVYTSSGWDSYSWAFRAKHSVVWLSIHNPGEEEDPACGPLIDSIAIKNLYPPPRTKGNMLRNGDLEEGPYIFPDATWGVLVPPIFEDEHSPLPGWMIMSDTKVIKYVDSPHHRVPQGARAVELVAGRETALVQEVATVPGRSYRLSFSVGDAGNGCKDSLAVEAYAARATAKVPYESQGTGGHKRAQLEFAAVANLTRVVFQSFNYHTKPDGTLCGPLVDDISLVSVRKRAARL

SEQ ID NO: 13429 - protein, 370 aa, Staphylococcus aureus subsp. aureus Mu50
MAPKLQAQFDAVKVLNDTQSKFEMVQILDENGNVVNEDLVPDLTDEQLVELMERMVWTRILDQRSISLNRQGRLGFYAPTAGQEASQLASQYALEKEDYILPGYRDVPQIIWHGLPLTEAFLFSRGHFKGNQFPEGVNALSPQIIIGAQYIQAAGVAFALKKRGKNAVAITYTGDGGSSQGDFYEGINFAAAYKAPAIFVIQNNNYAISTPRSKQTAAETLAQKAIAVGIPGIQVDGMDALAVYQATKEARDRAVAGEGPTLIETMTYRYGPHTMAGDDPTRYRTSDEDAEWEKKDPLVRFRKFLENKGLWNEDKENEVIERAKADIKAAIKEADNTEKQTVTSLMEIMYEDMPQNLAEQYEIYKEKESK

SEQ ID NO: 13430 - protein, 170 aa, Zea mays
  unsure (1)..(170): unsure at all Xaa locations
MYCLRWMPELVKDVYCDNQLIVTQYRDTRYPAFKEVSSIDIKQVMIYSTAAYALWQTLYYLFIMVGRRDKVESGIRLTSYSWLLNDPHGKKGFIQRSAFLFVEKYKLEMFMLLQLIYNVVTSLPXTLFISHFWLHTAFLICMYAVSVWNGANYYIEVFSRRYINELDKIK

SEQ ID NO: 13431 - protein, 324 aa, Streptococcus agalactiae
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGI

SEQ ID NO: 13432 - protein, 816 aa, Neurospora crassa
MPGGSWRALGCRRYLLYLPKIPGPGRAVVNTSTSTSRCGRGLLQNSSISSKIPPPQPTPIANHLPSNIPLRTLSAHAAARDDPSTHSHGNRKQGSSSFLAPHPAERLRYSEDGDGDDSNDYGSSESSWIDTGDIAEQLDHEDPLRQRLYDTLEDDTLVGVVHHRHPKRHRHSGKHVHYHESVSSSSAHSSRPSGQAGVVDKEAIRIPDAAPRTVSRAERLIASIMAGTRNPIHGLTGKPLMFDVSCCPAIYFTSIFVSLGVFLFGYDQGVMSGIITGPYFKDYFNQPTSAQIGTMVAILEIGALISSLLVGRIGDIIGRRKTILYGSCIFFVGGALQTMATDMAMMMTGRIIAGLGVGMLSTIVPVYQSEISPPHNRGKLACIEFSGNIIGYTTSVWVDYFCGFLEGNISWRLPLLMQCIMGALLGLGSLIIVESPRWLLDNDHDEEGIVVIANLYGGGDIHNPRARDEFREIKMGVLLARQEGERTYSEMFKRYSRRVFIAMSAQALAQLNGINVISYYAPLVFESAGWVGHDAVLMTGFNGITYLLSTIPPWYIVDRWGRRHILLTGAVAMVLSLSAISYFLYLDTHWTPSAVVVMVMIYNAAFGYSWGPIPWLYPPEILPLKIRSKGASLSTATNWAFNFLVGEMTPILQELIHWRLYLIHAFFCAVSFVIGEYLLTATPQGIQLTEFPVYFLYPETCGVRLEDMDALFGDSTNAFGTPTVSTPSLHAEVDPLVGPGSPVPRLDIRGRPLASAAIPGLPIDPPDEVEIINKSSSNQNRGGIGGLLSRLVGRRGRGSAEGSDSGSYAPLRQGDD

SEQ ID NO: 13433 - protein, 337 aa, Nostoc sp. PCC 7120
MKVRVGINGFGRMGRLALRAAWDWPELEFVHINEIKGGAVAAAHLLKFDSVHGRWTPEVEAEGERVLIDGTPLSFSEYGKPDDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVTRPTTVEEINALLKAASEQAPLQGILGYEERPLVSIDYKDDPRSSIIDALSTMVVDETQVKILAWYDNEWGYVNRMVELARKVALSLK

SEQ ID NO: 13434 - protein, 320 aa, Escherichia coli CFT073
MSKVFTIGEILVEIMASKIGQPFDQPGIWNGPYPSGAPAIFIDQVTRLGVPCGIISCVGNDGFGDINIHRLAADGVDIRGISVLPLEATGSAFVTYHNSGDRDFIFNIKNAACGKLSAQHVDENILKDCTHFHIMGSSLFSFHMVDAVKKAVTIVKANGGVISFDPNIRKEMLDIPEMRDALHFVLELTDIYMPSEGEVLLLSPHSTPERAIAGFLEEGVKEVIVKRGNQGASYYSANEQFHVESYPVEEVDPTGAGDCFGGAWIACRQLGFDAHRALQYANACGALAVTRRGPMEGTSRLMEIETFIQRHDMSIREAAQ

SEQ ID NO: 13435 - protein, 234 aa, Zea mays
  unsure (1)..(234): unsure at all Xaa locations
MFIESFRVESPHVRVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFTAANQGSRANNVIKGTKKEQVEQIIKDIREFKEKNKXDKVVVLWTANTERYSNVCAGLNDTMENLLASVDKNEAEISPSTLYAIACXVTERVPFINGS

SEQ ID NO: 13436 - protein, 229 aa, Mycobacterium tuberculosis CDC1551
MAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 13437 - protein, 556 aa, Zea mays
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKVSKNVYAMKKLKKSEMLRRGQVEHVKAERNLLAEVDSAYIVKLYYSFQDEEFLYLIMEYLPGGDMMTLLMRKDILTEDEARFYIAETVLAIESIHKHNYVHRDIKPDNLLLDRSGHLKLSDFGLCKPLDSSNFPNLNEPDYTSGKVTKPLPDTTWLSNPSAPRRTQQEQLSHWQKNRRMLAYSTVGTPDYIAPEVLLKKGYGMECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKPKRPTIKTMFESMDEEEPVQGSFLGMLPPKEGQPSSHSSVPQEKHQPRRK

SEQ ID NO: 13438 - protein, 150 aa, Glycine max
MGSEGSSVVVPRNFRLLEELERGEKGIGDGTVSYGMDDADDIYMQSWTGTIIGPPSLKLFCSRDYPDNPPSVRFQTRINMTCVNQETGVVEPHLFPMLANWKRERTMEDILIQLKREMMSPQNRKLTQPPEGNEESRVDQKGLVVRCCIV

SEQ ID NO: 13439 - protein, 394 aa, Zea mays
  unsure (1)..(394): unsure at all Xaa locations
MAAAALLRRIPAARAPATAFMAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTKKKXNVYKKGFNVESFGPDRKELRATLP

SEQ ID NO: 13440 - protein, 332 aa, Escherichia coli O157:H7 EDL933
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 13441 - protein, 364 aa, Oryza sativa
MAFHGHLPHEMTMQALGADDAAVAAAAAAGGVGAGGAPAWMRYNDGSFLHLQTTSDSSASPSGAAAAAAAAAAAGVQQWMGGGGGGEDAVAAAMGGGGEADAARCKAEILAHPLYEQLLSAHVACLRIATPVDQLPRIDAQVAQWQGVVAKYSALGAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKR

SEQ ID NO: 13442 - protein, 131 aa, Glycine max
  unsure (1)..(131): unsure at all Xaa locations
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 13443 - protein, 392 aa, Methanosarcina acetivorans C2A
MKACIMCGGAGTRLRPLTFKHPKPSIPILNKPSVRHLIEHLSREGFNEIVMTLGYMGERIEEQLGDGHMFGVHIDYVYEKEKLGTAGGVKNAEKYLKNEPFIVLGGDHVLNLDLREMYRFHEANDALITIGLLSIDDPREFGIADMDINNRIHRFLEKPKSGQIFSNLASTGIYICDPEIFNWIPENKKYDFAKDLFPALLAADKKINGMLVRGKWTDVGSSAAYRQAQRWMLDALPGTTIEGNFTTRNARIRGPLSIGNNVSIGSNSSLVGPIVIGENTVIGDSVLIGPYSVIGANCTIENNAKILSSYLFDGVSIGKNSNISGAVVADETAVGEECNLENGTVIGHKVVIGDNSTIHSGIKIWPEVVIEKNSSIKETVVNPAYDTTYEGS

SEQ ID NO: 13444 - protein, 200 aa, Glycine max
ILRTTSISTPISSSKSKPIFSTLLRSSPSTIFPPKSVTPTTLFVSATPFFTLHPKLGFRGGIVAMAAPGSLRKSEEEWRAILSPEQFRILRQKGTEFPGTGEYDKFYEEGVYNCAGCGTPLYRSITKFNSGCGWPAFYEGIPGAINRNPDPDGMRTEITCAACGGHLGHVFKGEGFPTPTNERHCVNSISLKFAPANSYS

SEQ ID NO: 13445 - protein, 170 aa, Metroxylon sagu
MGVYVFKRDVLLKLLRWRYPKCNDFGSEILPLAVKEHNVQAYLFNDYWEDIGTIKSFFDANLALTDQPPKFQFYDPKTPFFTSPRFLPPTKIEKCRILDAIISHGCFLRECSVQHSIIGVRSRLDYSAELKDTLMMGADYYETEAEIASLLSEGKVPIGVGQNTKISNCI

SEQ ID NO: 13446 - protein, 257 aa, Vicia faba
MASSKETFVYTAKLAEQAERYEEMVEAMKNVAKLDVELTVEERNLLSVAYKNVVGGRRASWRILSSIEQREETKGNEVNVNRIKEYRKKVESELSDICTDIMAVIDEHLIPNSSGESNVFYYKMKGDYYRYLAEFKSGDDRKEAADQSLKAYQEASTAAETELPPTHPVRLGLALNFSVFYYEILNSPERACHLAKQAFDVAIAELDSLNEESYKDSTLIMQLLRDNLTLWTSDIPEEGVEEQKAESARAPVGDNAE

SEQ ID NO: 13447 - protein, 645 aa, Neurospora crassa
MWAPPVRYGDENIPPADPTHQSKRSDSKIKAMMAVNGTLNAPPKRAACFDKSNTSKPLADGGNKDMLKNRVKPMVTTSSTRDLRSDGRENNRSAAEEHYMRPTATSKAASHGHQKYSSTAPLSSHAASGAYGGIRSHNAIAKLSAPVKKTTNVYRDNKVKEESTSHAPTSSSVDDLVAMVDKHIKDPRHYKSQPQLKSDQQHTLHRNQSKYVPNYENLNDVDDPDDSNADYAESYEDAVEQLSRDLDIPANTDPAAIVHANHMSIAQASYDSMPQGAPLAPSKPVRALPLPPNVSDPEEYSEDDDDQDLYDDQGYTTAHSYRSHCDNTTGGPPTLVAPKFTADIQKELDIAKAWVLEHQTEEEVEEENWDVSMVAEYGDEIFEYLRELEERMLPNPHYMDIQTEIRWSMRSVLMDWLVQVHHRFSLLPETLFLTVNYIDRFLSVKVVSLGKLQLVGATAIFVAAKYEEINCPSIQELVYMVDQGYSVEEILKAEKFMLTMLNFELGWPGPMSFLRRISKADDYDLETRTLAKYLLEVTIMDERFVGCPASYLAAGAHCLSRFFLQRGPWTHAHVHFSGYTLAQLRPLIISILDCCQEPRKHHGAVYDKYSHQRFKSASTFVEGKIANGFVLPIRTNASISDSAQS

SEQ ID NO: 13448 - protein, 610 aa, GIBBERELLA ZEAE PH-1
MATPSITLDRILAAAPVTTRGQPTQISVDTKGQRIAYPCGKSIFVRSIDDPSDAKEYTGHTAPTTVARFAPSGFKVASGDSSGMLKVWEPESIDGTRGEYAIISGRLNDIAWDGESQRVIAVGDGREQFGRCITADSGNSVGEIIGHSKSVNAVAMKPQRPFRAATVGDDGNMVFYHGAPYKFNNKSAQHTGFVLGAAYSPDGNTLVTVGADKRIQLYDGKTGEPTKEIGQGEHTGSIFAVSWSQDGKKFVTASADQTVKLWDFDAGNIIQSWKFGEDATVGDQQVGVVFVPGRSDGLIISLSLDGRLTYLTEGKQEPVRVVYGHNRGITALSTASDGKGADLWSGSFDGRVCHWDIKSGIATVVDGQSHTNQVAQFAVADGKAFSAGWDDNLRIVDESAKTFLRSSTKLQAQPKGVSAANGLVYVATYSGVSVYSGEKLVSEQSLDYTPGAIAASGSFVAVGANENSVRIYSAGSDGKLQEVKALSNPTGTISALAFSKDGSHLAAGNSVGKIYVYSVGSWELVADRWSAHTARVTSIAWDDTGAYAASGSLDTNVFIWCLEKKNQGKRIKAANAHKDGVNGVAWIEGGKIASAGGDASVKIWSVQNLP

SEQ ID NO: 13449 - protein, 693 aa, Desulfitobacterium hafniense
MAISTGRYTMENQQTNQKSLDLDAARVSHNKGYLTTNQGVGVSNTDDSLKAGKRGPTLMEDFIFREKVTHFDHERIPERVVHARGSGAHGYFQVYENLSHLTKAHFLSDPNLITPVFVRFSTVAGFRGSSDTVRDVRGFAVKFYTQEGNYDIVGNNMPVFFIQDAIKFPDLIHSLKPEPNNEMPQAASAHDTFWDFVVNTPETMHNVMWLMSPRAVPKSFRMMEGFGINTFRLVNAKGEFKFVKFHWKPVLGVHSLVWDEAQKVAGKDPDFNRRDLWETIEHGQAVEFELGIQVLKPEDEFRFDFDILDPTKLWPEELIPVQKIGKMTLNQNPDNFFAETEQVAFCPANVVPGIDFSNDPLLQGRLFSYLDTQLSRLGGPNFHQLPINRPLPKVNNNQRDGMHRMTIDEGQTSYYPNSLNKGEPHAARAGESHFEHYQEKVDGHVIRERSESFRDHYTQPAMFWNSMSDWERQHIIDAFRFELGKCKHKHTHQKLVDMLGNVDPELAQKVAEGLGATPPANGANPTTASSPALSMANTAKSPKTRKVAVLLESGFDKAQFDALTATLIAAGACFDVVSCKLGPVTAGDNGRVEGNQTYATTASVFYDAVYIPGGSHTEALKGSADVKGFLLDTFNHYKTIGLSGEASALLGLLPSGQKPAPGIVCESAGNMEIYANNFLAALTTGRHFERNVH

SEQ ID NO: 13450 - protein, 205 aa, Oryza sativa (japonica cultivar-group); identical to SEQ ID NO: 3435

SEQ ID NO: 13451 - protein, 441 aa, Zea mays
  unsure (1)..(441): unsure at all Xaa locations
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGERAVRAFAADVLRGLAYLHARSVVHGDVKARNVLVGAGGRAMLADFGCARALSGSGSARRPIVGATPAFMAPEVARGEDQGPPADVWALGCTVVEMATGRAPFGGMGGAGGALXAVXWIGYTDAVPEVPAWLSPEAGDXLAHCFARXAADRWTAARLLEHPFXVAFARHXDKAPRPSPKSALDAAAFWESETESEDEASGSASERIESLACSAGALPDWDGEGGWIDVLGEHCGAPGKASSVLVAVPAGEMDVGGGLPSEDGLEAEEXPFGGGGVPVPVPAADASAGRHEKHCSSSDCHALSCQLVPCNLVFNAIKLWVPTKKKKKKKNNKKKKK

SEQ ID NO: 13452 - protein, 298 aa, Arabidopsis thaliana
MARRGLLISFFAIFSVLLQSSTSLISSSSVFVNPSKVKQVSSKPRAFVYEGFLTELECDHMVSLAKASLKRSAVADNDSGESKFSEVRTSSGTFISKGKDPIVSGIEDKISTWTFLPKENGEDIQVLRYEHGQKYDAHFDYFHDKVNIVRGGHRMATILMYLSNVTKGGETVFPDAEIPSRRVLSENKEDLSDCAKRGIAVKPRKGDALLFFNLHPDAIPDPLSLHGGCPVIEGEKWSATKWIHVDSFDRIVTPSGNCTDMNESCERWAVLGECTKNPEYMVGTTELPGYCRRSCKAC

SEQ ID NO: 13453 - protein, 195 aa, Bacillus cereus ATCC 14579
MILMIDNYDSFTFNLVQFLGELGQELVVKRNDEVTISDIENMKPDFLMISPGPCSPNEAGISMEVIKYFAGKIPIFGVCLGHQSIAQVFGGEVVRADRLMHGKTSLMHHDGKTIFSDIPNPFTATRYHSLIVKKETLPDCLEVTSWTEEGEIMALRHKTLPIEGVQFHPESIMTSHGKELLQNFIRKYSPSATLC

SEQ ID NO: 13454 - protein, 564 aa, Hanseniaspora uvarum
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLNVPAKLLETKIDLALKANDAEAENEVVETILALVADAKNPVILSDACASRHNVKAEVKQLIDATQFPAFVTPLGKGSIDEKHPRFGGVYVGTLSSPEVKQSVESADLILSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKQLRYLTNFGATDYEAIPVKTVGEWKKLTADPAFKKNSTIRLIEVFLPEMDAPSSLVAQANLTAAINAKQD

SEQ ID NO: 13455 - protein, 286 aa, Nicotiana tabacum
MKSRGRFGWWSVRLPSVFLLCLFFFLLGFFGSALFSHQDVPSVRPRPRFLESVYQEDFDPLPIGETGEHSLISIPFQVLSWFPRALYFPNFASIEQCQSIIKMAKANMEPSSLALRTGETEETTKGIRTSSGTFISASEDKTGILDLIEEKIAKATMIPKTHGEAFNVLRYEIGQRYQSHYDAFDPAQYGPQKSQRAASFLLYLSDVEEGGETVFPYENGQNMDASYDFSKCIGLKVKPRRGDGLLFYSLFPNGTIDLTSLHGSCPVIRGEKWVATKWIRNQDQDD

SEQ ID NO: 13456 - protein, 464 aa, Oryza sativa (japonica cultivar-group)
MAASPAAAAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 13457 - protein, 572 aa, Oryza sativa
MASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKEPKKRGRRKVKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVE

SEQ ID NO: 13458 - protein, 431 aa, Chloroflexus aurantiacus
MTDAGAGPVKCSVINGVDMIRTLVMILAGGDSPALSVLTAERTEAAVPFGGKYRIIDFALSNCVNSGLYNVAVLTQYRPRSLHAHLGVGRPWDLDRAQGGLRLLHPSPTPDGGGWQRGTADAVRYNLDFVEDQQVDAVLLLAGDHIYKMDYGPLLKLHAEQEADVTMAVRSVSPHDAHRYGIVSVGSDGRVDRFVEKPRRADSNLASMGIYVFRKQFLIDLLRSTDAVDFGRHLLPQIVSSARAFAYNFQGYWADVGTVQAYYEANLALLAETPALDLYDPEWVIHTVSSDRPGAEIGVQARVENSLLSDGCRVYGTVIGSVLSPGVVVAAGAVVRDSVVLGDAVIEAGAVLDRCIIDEGVRIGEGAHVGFGDDNTPNAEAPERLNTGLTLVGLKAQIPAGVRIGRNVAIKPRTQPAAFPADGQVPSGATI

SEQ ID NO: 13459 - protein, 461 aa, Arabidopsis thaliana
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 13460 - protein, 411 aa, Triticum aestivum
  unsure (1)..(411): unsure at all Xaa locations
VDVSNGIHAFLRHLPCTFSVFVPEEEIHSGAHGIPAFPRRLPSPLWSSCPRSKITVMAMASTAKDGVPGKAFSPRKAPHRDRVAHSLPPEKREIFDSLNSWAEDNILVLLKPVERSWQPQDYLPDPSSDRFYDEVKELRERAEEIPDEYLVCLVGDMVTEEALPTYQKMLNILDGGVRDETGSSPTSWAVWTRAWTAEENRHGDLMNKYIYLTGRADMRQVEKTIQYLVGAGMDPKTEANPYEFFIYTSFQERATFISHGNTARHATKYGDLKLAQICGTIAADERRHELAYTKIVEKLFAVDPDYTVLAFASIMKRKITMPAHLMYDGQEDNLFEHFSAVAQRLGVYTAMDYADILEFLVKRWNVAGLTGLSGEGRRAQDYLCSLRTRFXKLVERAQGSGKQLPVVPFSW

SEQ ID NO: 13461 - protein, 397 aa, Cytophaga hutchinsonii
MISFDDAQKTVLSKKLETTPTQIPLLESIGNFYSADISADRNYPPFNRAAVDGIAFYWDGISPVKESYQIAGSIFAGEMWQKDIQAFECVWIMTGAPVPKQLNMLVRVEDISAQNNHIYFRKGLTFTRMQNIAKEGEDILKDTVVLTKGMRITPQHVSTLASLGYGFVPSYGFLTATILRTGNEITEPSTDVLAAWQIRDSNSFTIRSLLKDYPVTINMRSAQDTMEALVTQIEAGKHSNILILTGGVSAGAADLVPEALLACGFTCHFHKVEIRPGKPIWFGTHPTGCIAFGLPGNPFSVQIGVKVFVEPFIRACFNNRDKTFIHKILTHERLKKISFDEFIVADENIHGVCVKKHNGSGDISASLSSTGMIRHQAQKEKLEAGDTVDYYPWMINW

SEQ ID NO: 13462 - protein, 345 aa, Oryza sativa
  unsure (1)..(345): unsure at all Xaa locations
GIRHEGIITTSPHLSSRAPLPATAARDEGDRIGLGWIGEREWRRRRPSRPPTSPASPTSAAQASPPPPRRIRSSSASGAPAAAXQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 13463 - protein, 156 aa, Prunus dulcis
MDVRIAGLDSPLFSTLQHIMDFTDEPDKSFNAPTRTYVRDAKAMASTPADVKEYPNSYVFVVDMPGLKSGDIKVQVEDDNVLLITGERKREEEKEGAKYVRMERRVGKFMRKFVLPENANVEAISAVCQDGVLTVTVEKLPPPEPKKSKTIEVKIA

SEQ ID NO: 13464 - protein, 459 aa, Pleurochrysis haptonemofera
DPEYSIKETDILALFRCTPQPGVDPVEAAAALAGESSTATWTVVWTDLLTACDLYRAKAYRVDPVPSAADTYFCYIAYDIDLFEEGSLANLTASIIGNIFGFKAVKALRLEDMRMPYALLKTYQGPATGLIVERERLDKFGRPLLGATVKPKLGLSGKNYGRVVFEGLKGGLDFLKDDENINSQPFMRYRERFLYSMEGVNHAAAVSGEVKGHYLNATAATMEDMYERAEFAKDLGSVIVMIDLVIGYTAIQSMAIWARKTDMILHLHRAGNSTYSRQKTHGMNFRVICKWMRMSGVDHIHAGTVVGKLEGDPLMIKGFYNTLLDFKTDINLPQGLFFAQDWASLRKCVPVASGGIHCGQMHQLINYLGDDVVLQFGGGTIGHPDGIQAGATANRVALECMVIARNEGRDYISEGPQILRDAAKTCGPLQTALDLWKDITFNYASTDTADFVETPTANR

SEQ ID NO: 13465 - protein, 541 aa, Zea mays subsp. mays; identical to SEQ ID NO: 8125

SEQ ID NO: 13466 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 13467 - protein, 472 aa, Wolbachia endosymbiont of Drosophila melanogaster
MSTLITVAYGDGIGPEIMEAVLSILREAEAEISIDIIEIGERVYSKEWSHGISPSGWESIERTKILLKSPTTTPQGKGNKSLNVALRKNLGLYANIRPCISYHHVIENKFDKFDIVVIRENEEDVYTGIEHRLTGDSYQCTKIITRSGSEKICRYAFEYAKKHNRKKVTCLTKDNIMKMTDGTFHAAFDRIAKEYPDIKAEHYIVDIGMARVATEPENFDVIVTENLYGDILSDIVAQTSGSVGLAGSSNIGNEYAMFEAVHGSAPDIAGKNIANPSGLLNAAVHMLIYIGQVGTAKLIYDAWLKTLEDGIHTADLYKEKRSKQKVGTKEFAEAVIDNLGKKPKTLSELIIGSDPNSKVDKIQDNYEQDYKIKKLVGSDITLAWSKPADFDQIVKLFETSNPQIIAIYSKGLAIWPGSSKSSSDQITCRFIANNEITNSDVNNLLIKFEEHNFDVVRMDKLYLYDGKEGFFS

SEQ ID NO: 13468 - protein, 368 aa, Ipomoea batatas
MAATLSTLTALAGEKALQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKLMDLACKLLEVLSEAMGLEKEALTKACVDMDQKVVVNFYPKCPQPDLTLGLKRHTDPGTITLLLQDQVGGLQATKDGGKTWITVQPVDGAFVVNLGDHGHFLSNGRFKNADHQAVVNSERSRVSIATFQNPAPEATVYPLTVREGDKPIMEEPITFAEMYRRKMSKDLELARLKKFAKEQQQIVKAAAADKNLETKPIDQILA

SEQ ID NO: 13469 - protein, 576 aa, Oryza sativa
  unsure (1)..(576): unsure at all Xaa locations
MAAFSPHAGGSTQKKLDQRRAQSSKSWEAMAGGQLNVLSTLDQAKTQWYHFMAIVIAGMGXFFTDAYDLFCISLVTKLFGRIYYTDDSKATPGTLPPNVSPAVTGVALCGTLAGQLFFGWLXRDKLGRKSVYGFTLILMVVCSIASGLSFGHTPKSVIXTLCFFRFWLGFGIGGDYPLSATIMSEYANKKTRGAFIAAVFAMQGFGILFGAIVALVVSAGFRHAYPAPSYXENPAASLAPQAXDYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKIGWIPPAKTMNALEELYRISRAQALIALCGTIPGYWFTVSFIDIVGRFAIQILGFFMMTVFMLGLGVPYDHWTTTANHIGFVVLYAFTFFFANFGPNCTTFIVPAEIFPARLRSTCHGISAAAGKAGAIIGSFGFLYAAQDPHKPDAGYKPGIGVRNSLFVLAGSNLLGFICTLLVPESKGKSLEEMSDEEEDADDEVAPGVITQGVVAANHWCHLFSQL

SEQ ID NO: 13470 - protein, 389 aa, Prochlorococcus marinus subsp. marinus str. CCMP1375
MILAAGKGTRVQPITHVIPKPMIPILQKPVMEFLLELLKEHGFKEIMVNVSHLAEEIENYFRDGQRFGVEIAYSFEGRIEDGELVGDALGSAGGLKKIQDFQEFFDDTFVVLCGDALIDLDLSEAVKRHKEKGALATLITKSVPKDQVSSYGVVVTDEGDRVKAFQEKPSIDEALSNNINTGIYLFEPEIFKYIPSNKPFDIGADLFPKLVQVGAPFFALSMDFEWVDIGKVPDYWKAIRSVLLGDVRQVEIPGKEVMPGVFAGLNVAANWDKINIEGPIYVGGMTRIEDGSTIIGPSMIGPSCYICEGATIDNSIIFDYSRIGPGVQLLEKLVFGRYCVDKNGDHLDLQEAALDWLITDARRQDLGEPSPQQKAMAEFLGTDLIGSGG

SEQ ID NO: 13471 - protein, 175 aa, Lactobacillus gasseri
MAIDFKEHIASVKDFPNKGIIFRDITPILQDGKLYRAATHELAEYAKSRGAEVIVGPEARGFIVGCPVATELGIGFVPARKPHKLPREVESASYDLEYGSNVLEMHKDAIKPGQKVVICDDLMATAGTLHATKELIENLGGEVVGAAFYIELTDLKGREQFPDLDIYSLVKYHGA

SEQ ID NO: 13472 - protein, 249 aa, Fragaria x ananassa
MAYENKPNTDLDADAQRRLGRGKIEIKRIENTTNRQVTFCKRRNGLLKKAYELSVLCDAEVALIVFSNRGRLYEYSNNSSVRETIERYKKACADTSTNGSASEATTQYYQQEAAKLHNQINALQNINRGYMAEGLSNKNIKELKGMERKLERAITRIRSKKNELLFAEIEYMQKRELDLHNNNQLLRAKIAENERQQQSIIAITGGHGSYEIVQPTQPFHEARNYFQVNALQPNIHQYSCHDQVSLQLV

SEQ ID NO: 13473 - protein, 302 aa, Oryza sativa (japonica cultivar-group)
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCGNKMVRILCNDCGATSEVQFHLIAHKCQKCKSYNTRQI

SEQ ID NO: 13474 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 13475 - protein, 624 aa, Corynebacterium glutamicum ATCC 13032
MKSARPKSVAPKSGQALLTLGALGVVFGDIGTSPLYSLHTAFSMQHNKVEVTQENVYGIISMVLWTITLIVTVKYVMLVTRADNQGQGGILALVALLKNRGHWGKFVAVAGMLGAALFYGDVVITPAISVLSATEGLTVISPSFERFILPVSLAVLIAIFAIQPLGTEKVGKAFGPIMLLWFVTLAGLGIPQIIGHPEILQSLSPHWALRLIVAEPFQAFVLLGAVVLTVTGAEALYADMGHFGARPIRVAWFCVVMPALILTYLGQGALVINQPEAVRNPMFYLAPEGLRIPLVILATIATVIASQAVISGAYSLTKQAVNLKLLPRMVIRHTSRKEEGQIYMPLVNGLLFVSVMVVVLVFRSSESLASAYGLAVTGTLVLVSVLYLIYVHTTWWKTALFIVLIGIPEVLLFASNTTKIHDGGWLPLLIAAVLIVVMRTWEWGSDRVNQERAELELPMDKFLEKLDQPHNIGLRKVAEVAVFPHGTSDTVPLSLVRCVKDLKLLYREIVIVRIVQEHVPHVPPEERAEMEVLHHAPIRVVRVDLHLGYFDEQNLPEHLHAIDPTWDNATYFLSALTLRSRLPGKIAGWRDRLYLSMERNQASRTESFKLQPSKTITVGTELHL

SEQ ID NO: 13476 - protein, 566 aa, Glycine max
MHYLSRIFEPRKQTKTMDRKNPRRKPKLERRNALKYSSSEYDVVSSPSDDTLYTRSMEFYDRTSFRIEGVEGEFDRICRSLGLSGPEDFAIPAAAWEAMKFRSSSDILPRLKLDNLDIPEEDVEEESKVNEVRMFKSAEEGELSENHGVSDSVRVREIDESSNGIKGIRPPMLKPPPGTRVQVVDDSACSSWDLLRDLAPQGGEGLPLNHSNEEREVAEKEEGEVGTKESPKREEEQNVDNAARIAEIVAGLSESCSFSTSNEDDSSSSTTDPRSNNISPQGRIKRIITAGSWQKGEFLGGGSFGSVYEGISDDGFFFAVKEVSLLDQGTQGKQSVYQLEQEIALLSQFEHENIVQYYGTEMDQSKLYIFLELVTKGSLRSLYQKYTLRDSQVSAYTRQILHGLKYLHDRNVVHRDIKCANILVDASGSVKLADFGLAKATKLNDVKSMKGTAFWMAPEVVKGKNKGYGLPADIWSLGCTVLEMLTGQLPYCDLESMQALYRIGKGERPRIPDSLSRDAQDFILQCLQVSPNDRATAAQLLNHSFVQRPLSQSSGSSFPHIHGRKG

SEQ ID NO: 13477 - protein, 759 aa, Arabidopsis thaliana
MWRLRIGAKAKDNTHLFTTNNYVGRQIWEFDANAGSPEELAEVEEARRNFSNNRSRFKASADLLWRMQFLREKKFEQKIPRVIVEDAEKITYEDAKTALRRGLLYFTALQADDGHWPAENAGSIFFNAPFVICLYITGHLEKIFTHEHRVELLRYMYNHQNEDGGWGLHVESPSNMFCSVINYICLRILGVEAGHDDKGSACARARKWILDHGGATYSPLIGKAWLSVLGVYDWSGCKPIPPEFWFLPSFFPVNGGTLWIYLRDIFMGLSYLYGKNFVATSTPLILQLREEIYPEPYTNISWRQARNRCAKEDLYYPQSFLQDLFWKGVHVFSENILNRWPFNNLIRQRALRTTMELVHYHDEATRYITGGSVPKVIAVFHMLACWVEDPESDYFKKHLARVPDFIWIGEDGLKIQSFGSQVWDTALSLHVFIDGFDDDVDEEIRSTLLKGYDYLEKSQVTENPPGDYMKMFRHMAKGGWTFSDQDQGWPVSDCTAESLECCLFFESMSSEFIGKKMDVEKLYDAVDFLLYLQSDNGGITAWQPADGKLVEFIEDAVVEHEYVECTGSAIVALAQFNKQFPGYKKEEVERFITKGVKYIEDLQMVDGSWYGNWGVCFIYGTFFAVRGLVAAGKCYNNCEAIRRAVRFILDTQNTEGGWGESYLSCPRKKYIPLIGNKTNVVNTGQALMVLIMGNQMKRDPLPVHRAAKVLINSQMDNGDFPQQEIMGVFKMNVMLHFPTYRNMFTLWALTHYTKALRGL

SEQ ID NO: 13478 - protein, 294 aa, Pinus contorta
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVSGLEPAGIDILSKMLCLEPSRRITARSALEHEYFKDLGFVP

SEQ ID NO: 13479 - protein, 150 aa, Hordeum vulgare subsp. vulgare
MSIVRRSNAFDPFADLWADPFDTFRSIVPAFSGNSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKTEVKKPEVKAIEISG

SEQ ID NO: 13480 - protein, 375 aa, Arabidopsis thaliana
MPLSLQSPPCATLSASIQKGRWKTLAAGFSVTPLPAVNFSLRRSIPRILASASSSSSPSSSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHERLLFKIPATWQGIEAARLLESEGIQTHITFVYSFAQAAAAAQAGASVIQIFVGRLRDWARNHSGDNEIESAIKSGEDPGLALVKRSYNYIHKYGYKSKLMAAAVRNKQDLFSLLGVDYVIAPLKVLQSLKDSPAIPEDEKYSFVRKLTPETATHYHFTNKELVKWDQLSLASSMGPASV

SEQ ID NO: 13481 - protein, 256 aa, Pantoea endophytica
  unsure (1)..(256): unsure at all Xaa locations
GXAGGIGQALXLLLKTQLPSGSELSLYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILPXLSQIPGVSFTEQEVADLTKRIQNAGTEVVEAKAGGGSATLSMGQAAARFGLSLVRXLQGEKGVVECAYVEGDGQYAR

SEQ ID NO: 13482 - protein, 501 aa, Asparagus officinalis
MTVSITAAVQLFLLLLLLLQLLFVHHKTKPKTKCRSPPGPPPLPVIGNLHQLSLLLHQSLYRLSKIHGPIFKLSLGRVPVLVISSPSLAKQVLKTHDLAFCSRASTVSFKEYTYDGCDVAGAPYGDSWRNLRKIFVLNLLSSKKLTSFRLVQEEEIEGMISSIRTRSDTNATVNITEFVVRLANNITFRVAFGYRSEGEYGEKSRFQRLLESGNDTVASFYVGDYFPGLGWLDKITGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 13483 - protein, 522 aa, Triticum aestivum
MSSMQFSSVLPLEGKACVSPVRREGSACERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 13484 - protein, 226 aa, Triticum aestivum
MDGGGGGGGRPALQPAAAGGGASGPDEPRDARVVRELLRSMGLGEGEYEPRVVHQFLDLAYRYAGDVLGDAQVYADHAGKPQLDADDVRLAIQAKVNFSFSQPPPREVLLELARSRNKIPLPKSIAPPGSIPLPPEQDTLLSQNYQLLPALKPPTQTEEAEDEEEGANADGATSIPFPSQDQRGNEQQQQQPQSQSQGQRVSFQLNAVAAAAAKRPRMTIDQLNMG

SEQ ID NO: 13485 - protein, 339 aa, Pyrenomonas salina
MSIPIGINGFGRIGRLVTRAAFTNEGANCKVVAVNDPFIDLDYMVYMFKYDSTHGIWKGQVEKKGDKLVINGTEVTCFTERDPTAIKWGDAGAKYVVESTGVFTTIEKASAHVAGGAKKVVISAPSADAPMFVMGVNNKTYDGTPQIVSNASCTTNCLAPLAKVIDTNFGIVEGLMSTIHAITATQKTVDGPSGKDWRGGRGAAQNIIPASTGAAKAVGKVLPQLNGKLTGMSFRVPTPDVSVVDLTCKLAKPASYQAICDAVKKAESDPEYCGVIQYCDEEVVSTDFQGNSKSSIFDAKAGIALNETFVKLVSWYDNEWGYSNRVVDLIAHMQTVDKL

SEQ ID NO: 13486 - protein, 401 aa, Solanum tuberosum
MAFSAGKSYAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 13487 - protein, 565 aa, Glycine max
ARAARGLSGAIPPEISNMASLQVLQLGDNQLVGNIPTQMGSLKQLSTLALQYNKLTGQIPLSLGNLEKLSRLNLSFNNFSGTVPATLAYIEHLEVLDIQNNSLSGIVPSALKRLGEGFQGANNPGLCGVGFSTLRACNKDQDLNVNHIDTSDGDQPKNSNSSKALPEPAYVQLHCGQTHCSKSRRFPQTVITAGVVIVTLTFICAGFLTFFRYRRQKQRISNTLSSSSEGKVSLDQPKEFYTKSPSALVNIDYYSGWDQLSNGQNADAGGLSNEYLNQFRFNVDEVESATHYFSEANLLNRSKFAAGYKGVLRDGSLVAIRSISVTCCKTEEAEFVKGLNLLTSLRHENLVRLRGFCCSRSRGECFLIYDFATMGNLSQYLDIEDGSSHVLEWSKRVSIIKGIANGIGYLHSNEESKPTIVHQNISVENVLLDYQFNPLIRDAGLPMLLADDVVFSALKVSAAMGYLAPEYITTGRFTEKSDIYAFGVIILQVLSGKTTIGSSIRTAVESFRFDDSVDTNLKGIYSKSEAATLSKLAIQCTHELPDQRPTMVDVIQELSVSSAHI

SEQ ID NO: 13488 - protein, 236 aa, Streptomyces coelicolor
MKAVQVVGYGKNLEMAEVPAPEVTGPYDVIVRIGGAGVCRTDLHILEGQWAEKSGVELPYTIGHENAGWVHAVGSAVTNVSEGDKVIVHPLITCGLCRACRAGDDVHCENNRFPGIDTAGGYAEYLKTSARSVVRLDDSLEPADVAALADAGLTAYHAAAKAARRLRPGDRCVVIGAGGLGHIGIQVLGALTAAEIVVVDRNPDAVDLAVSVGADHGVLADGGHVDRVRELTGGHG

SEQ ID NO: 13489 - protein, 215 aa, Zea mays; identical to SEQ ID NO: 6590

SEQ ID NO: 13490 - protein, 151 aa, Glycine max
  unsure (1)..(151): unsure at all Xaa locations
HASAHASAQSSLNRTASISWRCVHYLLSVPNKPIALVDDFLTLFKPLSHSPPQNSLFSRLRRIAHKAKAKPQELEVTVASDAFTQFKHLLLPITDRNPYLSESTRQAIATTSALAKKYGADITVVXVIDEQQKESLPEHETQLSSIRWHLS

SEQ ID NO: 13491 - protein, 243 aa, Brassica oleracea var. botrytis
MGRGRVQLKRIENKINRQVTFSKRRSGLLKKAHEISVLCDAEVALVVFSSKDKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGASSLIGPNSLLPAWMLRPATNE

SEQ ID NO: 13492 - protein, 328 aa, Glycine max
MNYIQTKCVVKRKGKETGESETLCFTKSKDNNNNNMCDRHCGKRYPLLSFWELPEFMKDNEYILRYYRANWPFKQALFSLFRWHNETLNVLTHLIGFLLFLGLTLANLMKPKVVFFFKCGKKSLVIARWPFFVFLGGSMFCLLSSSMCHLFCCHSRDLNLFLWRMDYVGIVVMIITSFFPQIYYVFLCEPHWQIIYLAGITAMGLFTIATMLSPTLSTSKYRTFRAMLFCSMGLFGIVPAIHACFVNWSNPRRNITLAYEIGMALSYLTGTFFYVTRIPERWKPGWFDLAGHSHQIFHALVVVGALAHYAATLQMLEWRDSFGCDTVP

SEQ ID NO: 13493 - protein, 142 aa, Triticum aestivum
CVEEIDPSAEDKELKHQLLRKYGGYVGSLRQEFCKRRKKGKLPKEARQKLLHWWELHSKWPYPSETEKIALAESTGLDQKQINNWFINQRKRHWKPAPEDMPFSVMDGGVGVGVSFLPAPQGPALYMDRAPFMVDGMYRLGS

SEQ ID NO: 13494 - protein, 542 aa, Aspergillus fumigatus
MSILALVEDRPTPKEVYNWKIYLLAAVASFTSCMIGYDSAFIGTTLALSSFREEFGFSTMSKTAVNLVSANIVSCYQAGAFFGAFFAYPIGHFWGRKWGLLFAGTIFTLGAGLMLGANGDRGLGLLYGGRVLAGLGVGAGSNITPIYISEMAPPSIRGRLVGVYELGWQIGGLVGFWINYGVSETLAPSHKQWIIPFAVQLIPSGLLLIGAVFLKESPRWLFSRGRREDAIKNLCWIRQLPADHIYMIEEIGAVDQALEEQRTTIGLGFWKPFKAAGTNKKVMYRLFLGSMLFFWQNGSGINAINYYSPTVFKSIGLHGANTSMFSTGIFGVVKTVVTFVWLLYLIDRVGRRLLLLIGAAGAAVCLLIVGAYIKIADPASNPTQEMTGGGIAAMFFFYLYTVFYTPSWNGTPWVMNSEMFEPNMRSLAQACAAASNWLWNFLISRFTPQMFAKMEYGVWFFFASLMLLSIVFVFFLVPETKGIPLESMDVLFESKPIWRAHATVLAKLREDEEQFRHDIEESGYSKTGEQQVEHVSEDLPKV

SEQ ID NO: 13495 - protein, 222 aa, Chasmanthium latifolium
IENKISRQVTFAKRRNGLLKKAYELSLLCDAEVALIIFSGRGRLFEFSSSSCMYKTLERYRSSNYNSQEVKAPLDSEINYQEYLKLRTRVEFLQTTQRNILGEDLGPLSMKELEQLENQIEISLKHIRTRKSQVLLDQLFDLKTKEQELEDISKGLRKKLHETSGENALHISWEEGGHSGASGNAVEPYQGFQQHRENESSLQIGYRQQAYMEQLNNEDMED

SEQ ID NO: 13496 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDTETGYSNKVLDLIAHISK

SEQ ID NO: 13497 - protein, 556 aa, Pyrobaculum aerophilum str. IM2
MGIPGGQIMPLFDALYGQDIETILFRHEQGAIHAAEGYARVSGRPAVVAVTSGPGATNLVTGITDAYMDSTPVVAITGQVVTSVFGRDGFQETDILGVVTPVTKFTYQVKKPSEATSAFKTAYEISIIGRPGPTLIDLPRDIQLAPAPDYEEKIIVNREKFIPPPPDEDKLRLAAKYLIEAKRPVILVGGGVLWSGATPEVLEVSRLLNAPIVSTLPGKTAVPHDYPLYMGPAGMHGRVEADAALANADVILAVGTRFSDRTWGRFKELIENVTSGKLKLIHIDIDKSEIGKNVKPTVGIVGDAKIALRKLIDYIQSGAIQNNRFISWLLNIRKMYDEAMSKIANSTPGFHPWKALKVIRNAAPRNTITVTGVGSHQMWAEIAWDVYEPGSFITSAGLGTMGFCVPAALGAKLADRSRPVLCIDGDGSFQMTMNNLALVRDYNLPIVVTIFDNRALQLVKQWQVYLYKRRIIATEFSPRPDFLKIAEAYDIEGVRPESYEELERVVSRALKNDEPLIVDLIIDSEYDIVLPWVKPGDWLTSVIMPEGMHVQLTYED

SEQ ID NO: 13498 - protein, 369 aa, Escherichia coli K12
SYYHHHHHHLESTSLYKKAGLKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 13499 - protein, 157 aa, Triticum aestivum
  unsure (1)..(157): unsure at all Xaa locations
MAPAVMASSATTVAPFQGLKSTAGLPVSRRSSASLGSVSNGGRIRCMQVWPIEGIKKFETLSYLPPLSTEALLKQVDYLIRSKWVPCLEFSKVXFVFREHNSXPGYYNGRYWTXWKLPMFGCTDAXXVLNEVXEXXKXYPDPIRFIGFKTAQVXXSV

SEQ ID NO: 13500 - protein, 122 aa, Zea mays
  unsure (1)..(122): unsure at all Xaa locations
RPGTATHLPSVWRRHTTDSADTDPYSCLHRRSTTECRARVGAHIKLMAKVQDENEVPFRIKRXTQMNNLTNAYCDQQAVDLNAXALLRYARRLPEKDTPDGMKMKKSCWTDTIASPYRTQSA

SEQ ID NO: 13501 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 13502 - protein, 428 aa, Microbulbifer degradans 2-40
MSKIANVIGFEVMDSRGNPTVMAEVVLESGVVGTACAPSGASTGSREALELRDGDKSRYLGKGVLKAVANINETIKPLLVGKDVAAQRELDDIMLKADGTENKANLGANAILAVSLAAAKAAAQDKGIPLYAHIADINGTPGKYTMPVPMMNIINGGEHADNNVDIQEFMIQPVSAPNFTEALRMGAEVFHSLKKVLAGRGLNTAVGDEGGFAPNLPSNEAALEAIAEAVAAAGYKLGEEITLALDCASSEFYKDGVYDMSGEGKKFSPEEFADYLAELASKYPILSIEDGMDESDWDGWKVLTEKIGSTCQLVGDDLFVTNTKILKEGIDKSIANSILIKFNQIGSLSETLDAIKMAQEAGYTAVISHRSGETEDTTIADLAVATAAGQIKTGSLSRSDRVAKYNRLLRIEAELGEKAPYRGRAEFK

SEQ ID NO: 13503 - protein, 130 aa, Triticum aestivum
  unsure (1)..(130): unsure at all Xaa locations
MASDAMASPFAPLTNQPQQQQPSHEHPAAPPPKKKRNLPGTPDPDAEVIALSPRTLMATNRFVCEICGKGFQRDQNLQLHRRGHNLPWKLRQRSGKEPRKRVYVCPXKSCVHHNPSRALGDLTGIKKHFC

SEQ ID NO: 13504 - protein, 175 aa, Oryza sativa
  unsure (1)..(175): unsure at all Xaa locations
MQSQIVCHGCRNILLYPRGAPSVCCAVCHAVSSTAPSPGMDIAHLICGGCRTLLMYTRNATSVRCSCCDTVNLVRPVSSIAHLNCGXCQTVLMYPYGAPSVKCAICNFSTNTGMITMRHLPPNGNFIYCPIXPLLPTTSNSQNVTVVVGKSYGRVDAKGELVGDAVGGVTTGGKK

SEQ ID NO: 13505 - protein, 305 aa, Glycine max
  unsure (1)..(305): unsure at all Xaa locations
GSSSTRICLSGSSGSRYNTVHGQWKHFDVKVKDSKTLLFGEKXVTRFGSRNPEEIPXGEVGACYVGESTGVFTDTDKAAAHSHAGAKKVVISGPSKDAPMHVDGVNESEYXPELDIASNASSTTKXLAALAKAMNDRFGIVEGLMTTVHAITATQKTVDGPSNKDWRGGRAASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 13506 - protein, 481 aa, Chlamydomonas reinhardtii
MSSTPSATAIDHGATYSDLLIIQGAIVFFLQVGFVSLEVGYGRSKNVKNILLKNTVNILLCAICWWAVGYAFSYGSSTDGFIGTSGFFHDGGLGAAKLWFYSWTFCLSTVTIVSGCLAERTSLVAYPVFTVLMASWVHPVVVHWAWSRDSWLLGISSECRFLDFAGGTVVHICGGMMGLVGAALVGPRIGRFEEGRAKELPGHDVSSVAIGTLFLWFGWFGFNCGSAYVYMGNMAAAAAEAAASAVASGDTSADVYASAAAAVSAAVTSGANATLHPGSTPADRVALNMTLCASVSGLTALLLSSLRSGTVDLCVCCNSLLAGLVMSTPACGFITSWAAVIYGLVAAALYMGGTRMLVRFHVDDPLESSAIHFGCGGVGTLLLALLARPTYVQELTGYDCGGLVYGGRKGAILLGLQLLGIAAITAWTAFFSVLVFYLLRRLGRLRVDQVTELAGLDNMEHGGPAYPEFNLVPYNTGSAER

SEQ ID NO: 13507 - protein, 446 aa, Streptomyces avermitilis MA-4680
MAPAITLAAEAPKLSAANTGFMLICSALVLIMTPGLAFFYGGMVRVKSTLNMLMMSFISMGIVTILWVLYGFSLAFGTDKGSLIGWTSDFVGFTGIGKVELWPGYTIPVYVFATFQLMFAIITPALISGALADRVKFTAWSLFVALWATVVYFPVAHWVWGTGGWAFDLGVIDFAGGTAVHINAGAAALGVILVIGKRVGFKKDPMRPHSLPLVMLGCGLLWFGWFGFNAGSWLGNDDGVGALMFINTQIATAAAMLAWLAYEKIRHGAFTTLGAASGAVAGLVAITPSGGAVSPLGAIAVGAIAGVLCAMAVGLKYKFGYDDSLDVVGVHLVGGVAGSLLIGFFASGGGQSDATGVFYGDHSFDQLWKQCAGVFAVLAYSLVVSAILAFLIDKTIGMRVSEDEEIAGIDQAEHAETAYDFSGAGGGAARILPAPLADTATKKVDA

SEQ ID NO: 13508 - protein, 431 aa, Prochlorococcus marinus subsp. pastoris str. CCMP1378
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNKADLTVAALPVDESQAEGFGLMRTDDLGNIKEFSEKPTGEKLKSMAVDTSKFGLTKESASEKPYLASMGIYVFSRKTLFDLLNKFPSYTDFGKDIIPEALSRGDTLKSYVFDDYWEDIGTIGAFFESNLALTQQPKPPFSFYDEKFPIYTRPRYLPPSKLVDAQITDSIVCEGTILKSCSILHCVLGVRSRIESDSVIEDTLVMGSDFFESLEERIELRKGGGTPLGVGEGSTIKRAILDKNARIGDNVVIVNKDRVEEADKPDVGFYIRNGIVVVVKNATIANGTII

SEQ ID NO: 13509 - protein, 211 aa, Brassica rapa
VSKFTVGDVVGVGVIVGCCGSCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLACLKLDGKLILMGVINTPLQFITPLVILGR

SEQ ID NO: 13510 - protein, 759 aa, Costus speciosus
MWRLKIAEGGGPWLRTKNNHVGRQVWEFDPSLGTPEEIAEVERVREAFRETRFEKKHSADLLMRLQFAKENPLEMNYPIIKIEEHEDVTEELVVTSLRKAISRVSTLQAHDGHWPGDYGGPMFLMPGLIITLYVTGALNTVLTSEHQKEIRRYLYNHQNEDGGWGLHIEGESTMFGSALTYVILRLLGEGPDDGDGAMEKGRKWILDHGSATAITSWGKMWLSVLGVFDWSGNNPLPPEMWLLPYFLPVHPGRMWCHCRMVYLPMSYIYGKRFTGPITPLILSLRKELFNLPFDQLDWNKARNECAKEDLYYPHPFIQDVLWASLHKFVEPILMHWPGSKLREKAVNTAMQHVHYEDENTRYICIGPVNKVLNMLCCWIEDPNSEAFKLHLPRVMDYLWLAEDGMKMRGYNGSQLWDTAFTVQAIISTDLFEEFGLALTKAHEFIKKTQVLEDCPGDLNFWYRHISKGAWPFSTADHGWPISDCTSEGLKAALLLSKISPEIVGDPLDGKSLYDAVNVILSLMNNDGGFATYELTRSYAWLEIINPAETFGDIVIDYPYVECTSAAIQALTLFKKTYPGHRREEIDNCIRKSARFIEKIQLADGSWYGSWGVCFTYGIWFGMKGLLAAGRTYETSSCIRKACDFLLSKQVASGGWGESYLSCQNKVYTNLEGNRAHAVNTGWAMLALIDAGQGERDPKPLHRAAKVLINMQMENGEFPQQEIMGVFNKNCMISYSEYRNIFPIWALGEYRRRVLCSQFH

SEQ ID NO: 13511 - protein, 354 aa, Guillardia theta
MSLVGNQRYSVIGRVVGSGSFGVVFQAKCRSNEETVAIKKVFQDDRYENREVEIMSMLVHSNILDLKHCFNFSEGNDLYYNLELEFFAENIHRVCQHYSNHKQTLPTIYVKLYMYQVLRALGYLHSMGICHRDIKPQNLLIDPATQHLKLGDFGSAKLLTLNEPSISYICSRYYRAPELLLGAIDYTNSIDMWSVGCVMGELVIGFPFFRGESGTDQLVEIIKVLGTPTKAQVRAMNNDYLEFQFPRLSSHPWENVFHGKHLEPEAIDLIHKMLDYLPSRRITAIKAISHPFFKQLKIKGAKLPNSKNLPLLFDFSKKEFEYSSRFTTEISTQKYLLFYCKSFLCKWYFGISIC

SEQ ID NO: 13512 - protein, 245 aa, Wolbachia endosymbiont of Drosophila melanogaster
MIILSNLSCYAVFGIELEFYIEGIEKEYLFLNSIKNKIASLEFSCEKENSTHQYEIKSGCYTNSYNLIKHFELAKQSLTETAQKLGGNVSFKAKPYLDRAGSALNVHVNLVNSNNGNLFYINEQKYSDYLIHSIGGLCAMMKKHMLFFAPNDDSYLRFQYPDIHTPTTISWGVNNRTAAIRIPYFGNDSKRCRLEHRVPGTDCNLEKVLTAIIEGIVFGIENKIAPPNRVYGIASDPQYKMESLI

SEQ ID NO: 13513 - protein, 419 aa, Grateloupia asiatica
DTDVLALFRVTPQPGVDPIEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKTW

SEQ ID NO: 13514 - protein, 364 aa, Salmonella enterica
MALFNTAHGGNIREPATVLGISPDQLLDFSANINPLGMPVSVKRALIDNLDCIERYPDADYFHLHQALARHHQVPASWILAGNGETESIFTVASGLKPRRAMIVTPGFAEYGRALAQSGCEIRRWSLREADGWQLTDAILEALTPDLDCLFLCTPNNPTGLLPERPLLQAIADRCKSLNINLILDEAFIDFIPHETGFIPALKDNPHIWVLRSLTKFYAIPGLRLGYLVNSDDAAMARMRRQQMPWSVNALAALAGEVALQDSAWQQATWHWLREEGARFYQALCQLPLLTVYPGRANYLLLRCEREDIDLQRRLLTQRILIRSCANYPGLDSRYYRVAIRSAAQNERLLAALRNVLTGIAPAD

SEQ ID NO: 13515 - protein, 477 aa, Zea mays; identical to SEQ ID NO: 13092
  unsure (1)..(477): unsure at all Xaa locations

SEQ ID NO: 13516 - protein, 387 aa, Aquifex aeolicus VF5
MFEFSDRLKVLPPYLFAELDRKKQEKIEQGVDVIDLGVGDPDMPTPKPIVEAAKKALENPENHKYPSYVGKYEFRKAVADWYKRRFDVDLDPNTEVITLIGSKEGIAHFPLAFVNPGDIVLCPDPAYPVYRIGAIFAGGTPYTVPLKEENNFLPDLDSIPEDVAKKAKIIWINYPNNPTSAPPTLEFYKKLVDWAKEYNVIIASDNAYSEIYTGQEKPPSILQVPGAKDVAIEFHSLSKTYNMTGWRIGMAVGNKELVAGLGKVKTNVDSGQFGAVQDAGIVALNLPEEEVEKIRDVYRERKKIMTEALEKIGLEIYRSDYTFYLWIKVPEGYTSAEFVGRLIDEAGIVCTPGNGFGEYGEGYFRISLTVPTERLLEAAERIKNLKL

SEQ ID NO: 13517 - protein, 191 aa, Populus alba
RLVPDTVYLTVNYIDRYPSGNVMNRQRLQLLGVACMMIAAKYEEICAPQVEEFCYITDNTYFRDEVLEMESTVLNYLKFEMTAPTAKCFLRRFVRAAQGIIEAPSMQLECLANYIAELPLLEYSMLCYAPSLVAASAIFLAKYILLPSKRPWNSTLQHYTLYEPVDLSDCVKDPHRLCCGDHNSTLPAIRE

SEQ ID NO: 13518 - protein, 433 aa, Sarcodia sp. SF2000
EASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEGVNRAIAATGETKGHYMNVTAATIEEMYERAEFAKELGSIIVMIDLVIGYTAIQTMAIWARRNDMILHLHRAGNSTYSRQKIHGMNFRVICKWMRMAGVDHIHAGTVVGKLEGDPLMIRGFYNTLLQTHLAVNLPQGIFFEQDWASLRKVTPVASGGIHCGQMHQLLDYLGIDVVLQFGGGTIGHPDGIQAGATANRVALESIVIARNEGRNYVAEGPLILQDAAKTCGPLQTALDLWKDITFNYTSTDTADFVETPTANI

SEQ ID NO: 13519 - protein, 624 aa, Bradyrhizobium japonicum USDA 110
MDTQPIRLPSVAGATRSAGYPTRPPLRRFLTDCHEEFRGDSSGELADYIPELKRANPDHFGIALVTIDGHVYEVGDSAVPFTIQSVSKAFVFALALETVGEERVSATIGVEPSGEAFNSIRLTNDNRPFNPMVNAGAIACSGLIYEVDGKGAFERVRSKLSEFAGRELGVDEAVHASETATGNRNRAIAWLLRNYAVLPDDVDAVLDVYFRQCAILVTARDLAVMAATLANRGINPVTGAQVITPHIVARTLSVMTSSGMYDYAGEWTYRVGIPAKSGVGGGIVAALPSQLGLGTFSPLLDNHFNSVRGLKVCEALSARFDLHMLNRNADVRTSVMADYDVYGISSRRSRQPHEQQILDERHSDIRIVELVGALNFGTIDYVTRRLTSEPPNAPLLIIDFRRVPDITAAGAELLGETLTALGNANVTTILSGLEEASAVWAAIAARTGDPRRLRRFALLDDAIEWAEDQVIYRFGGFTDVKESVHLGEQALLAELDTDEIAAIVKLSTTRHYTAGQRVIAAGAPANSLFFLQSGMVSVKLRSGVRLASLGPGMEFGEMAILERTRSADVFADTPVACLELPLDSFADYRRLHPETALKIMRNLAAILARRLVAANAKVDLLSAY

SEQ ID NO: 13520 - protein, 393 aa, Streptococcus mutans
MAEKVSFEEGKLQVPDKPVIPYIEGDGVGQDIWKNAQIVFDKAIAKVYGGHKQVIWREVLAGKKAYKETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQKFTEGGFRKWGYELAKREYAAELASGQLVVDDIIADNFLQQILLKPERFDVVALTNLNGDYASDALAAQVGGIGISPGANINYQTGHAIFEATHGTAPDIAGQDLANPSSVLLSGCMLFDYIGWSKVSDLIMKAVEKAIANGQVTIDFAKELGVEALTTCQFSEVLLTYL

SEQ ID NO: 13521 - protein, 311 aa, Haemophilus somnus 129PT
MKIAVLGAAGGIGQALALLLKLQLPAGSELSLYDIAPVTPGVAADVSHIPTAVKIQGFAGEDPTPALENADVVLISAGVARKPGMDRSDLFNINAGIVKNLIEKVAKTCPKACVGIITNPVNTTVAIAAEVLKKAGVYDKRKLFGVTTLDVLRSETFVAELKGLNVSRIAVPVIGGHSGVTILPLLSQVQYAEWEEDEIAPLTKRIQNAGTEVVEAKAGGGSATLSMAQAAARFALSLVQGLSGETVVECTYVEGDGKYARFFAQPVRLGKEGVEEILPVGTLSAFEQKALEDMLPTLRADIELGEKFVNN

SEQ ID NO: 13522 - protein, 468 aa, Neisseria meningitidis
MSIKNVVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 13523 - protein, 126 aa, Glycine max
PSSYFEEKITSFDVCIRRGGGHYEEKKPSDQGAHINLKVKGQDGNEVFFRIKRSTQLKKLMNAYCDRQSVDFNSIAFLFDGRRLRAEQTPDELEMEDGDEIDAMLHQTSSGHKFFQMYDEHFHQKA

SEQ ID NO: 13524 - protein, 62 aa, Brassica napus
MRGILADWLVEVSEEYTLVPDTLYLTVYLIDWFLHGNHIERQNLQLLGITCMLIASKYEEIY

SEQ ID NO: 13525 - protein, 339 aa, Guillardia theta
MPTKIGINGFGRIGRLVTRAAFSNKKADCQVVAVNDPFIDLDYMVYMFKYDSTHGIWKGSCEKKGDKLVIDGCEITCFTERDPTAIKWAAAGAIYVVESTGVFTTIDKAQAHLSGGAKKVVISAPSADAPMFVMGVNNKAYDGTPTIVSNASCTTNCLAPLAKVVERNFGIVEGLMSTVHATTATQKTVDGPSGKDWRGGRGAAQNIIPSATGAAKAVGKVLPELNGKLTGMAFRVPTPDVSVVDLTVKLAKPASYQQICDAIKAATTDPEYCGVIAYTDDEVVSTDFLGNSYSSIFDAKAGIALNDTFVKLVSWYDNEWGYSNRVVDLIAHMATVDKF

SEQ ID NO: 13526 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 13527 - protein, 302 aa, Spirochaeta aurantia
RIGRNVLRAALGVPGLRIVAVNDLTDSATLAHLLKHDSILGNLSVPVTAGPGVITVDGQDIKVFAERDPGLIPWSSVGVDVVIEATGRFAEKDKAEVHITKGGAKRVIISAPAKGDDLTIVMGVNHQNYDPAKHRVVSNGSCTTNGLAPAALVLHEAFGIEHGLMNTTHAYTNSQVLHDQPEKDLRGARAASLSIVPYSSGAAKAIGKVIPSLDGKLTGYSLRVPVPVVSIVDLTVTVSKDVTVEEVNAAFRKAAESGPLQGILGYSEEPLVSSDYQGDPRSSIVDALSTLVIGKRMVKILA

SEQ ID NO: 13528 - protein, 459 aa, Staphylococcus aureus subsp. aureus Mu50
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 13529 - protein, 475 aa, Synechocystis sp. PCC 6803
MYEKLQPPSVGSKITFVAGKPVVPNDPIIPYIRGDGTGVDIWPATELVINAAIAKAYGGERKINWFKVYAGDEACELYGTYQYLPEDTLTAIKEYGVAIKGPLTTPVGGGIRSLNVALRQIFDLYTCVRPCRYYPGTPSPHKTPEKLDIIVYRENTEDIYLGIEWAEGTEGAKKLIAYLNDELIPTTPALGKKQIRLDSGIGIKPISKTGSQRLVRRAILHALRLPKAKQMVTLVHKGNIMKFTEGAFRDWGYELATTEFRAECVTERESWILGNKESNPDLTIEANAHMIDPGYDTLTEEKQAVIKQEVEQVLNSIWESHGNGQWKEKVMVNDRIADSIFQQIQTRPDEYSILATMNLNGDYLSDAAAAVVGGLGMGPGANIGDSAAIFEATHGTAPKHAGLDRINPGSVILSGVMMLEFMGWQEAADLIKKGIGAAIANREVTYDLARLMEPKVDKPLKCSEFAQAIVSHFDD

SEQ ID NO: 13530 - protein, 196 aa, Escherichia coli CFT073
MMNTLRIGLVSISDRASSGVYQDKGIPALEEWLTSALTTPFELETRLIPDEQAIIEQTLCELVDEMSCHLVLTTGGTGPARRDVTPDATLAVADREMPGFGEQMRQISLHFVPTAILSRQVGVIRKQALILNLPGQPKSIKETLEGVKDAEGNVVVHGIFASVPYCIQLLEGPYVETAPEVVAAFRPKSARREVSE

SEQ ID NO: 13531 - protein, 312 aa, Streptomyces coelicolor A3(2)
MPRRPIDITIPDLRDTRAVVTGASDGMGLGMAIRLASAGAQVVLPVRNPRKGEAALTKIRQHAPDADVSLRSLDLSSLASVAALGKTLLEEGQPIHLLLNNAGVMTPPERQATVDGFELQFGTNHLGHFALAAHLLPLLRAGQARVTSQVSIAANQHAINWDDLNWECSYNGRKAYSQSKIALGLFALELNRRSEAGGWGITSNLSHPGVAPTSLLAARPEVGRDKDTVLVRMIRAMSARGVIVGTVETAQLPALMAATSAAAKPGGFYGPSGPGHLGGPPGEQELYSRLRSADEAQRVWRTSEELTGTHLR

SEQ ID NO: 13532 - protein, 484 aa, Agrobacterium tumefaciens str. C58
MTTFSASNWIDGTFVSSSKRGRSIDPATYETIGDYPDDGGAAAQSAIEAAKRAFRGTAWRDDAELRARVLDQMASAIERNRERLIDILSLENGKLLGEAALEIDGSPSKLRYWAAMARTEAGRAKSPKPGSLSVILRQPMGVAGIIVPWNSPVILSVRSFAPALAAGCTVVVKMPGQTAQVGSVITEVLAEATDLPEGVVNMFVESGADGAALLVESPDVPTISFTGSTQTGRTIGAIGAKRMKRFGLELGGKTPMIVFDDADLEAMLPVLEKALTIFAGQFCMTGSRLLVHSSIYELVRDRLAERLRAVKVGPASDPASDMGPLIDKENVARVDSVVKDALSKGATVVVRGGPVPEGPLAKGAFFRPSMLEVFDNSLPIVQQETFGPVITIQRFSDEREAVVLANDNDYGLSASVWTRDLDRSLRVAQALEAGSVFVNDWAKVYDGTEEGGFKQSGLGRLNGVAAIEDFIEYKQVALKPGLLR

SEQ ID NO: 13533 - protein, 461 aa, Pseudomonas putida KT2440
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 13534 - protein, 219 aa, Glycine max
TWFLVDIVFYSQVLFQSEIYKRYLDKKEDVDVYQETFHAAWIQAVIAVCSTIPGYFFSMYFIDKWGRVKNPMMGFFFMALAFFSIGIPYYSYWTTKEHHKNKVFMVLYGLAFFFANFGPNTTTFIVPAELFPARFRSSCHGISGAVGKVGAIIGSVGFLWASHRKKEDGYPKGIGMKVSLIILGGVCLLGMVITYFFTRETMGRSLEENEVEIEEQDNL

SEQ ID NO: 13535 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 13536 - protein, 373 aa, Oryza sativa (japonica cultivar-group)
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 13537 - protein, 196 aa, Mitthyridium sp. Wall 3650
GGAKKVVISAPSKDAPMFVIGVNEDKYTNEDIVSNASCTTNCLAPLAKVINDKFGILEGLMTTVHATTATQKTVDGPSNKDWRGGRSAGTNIIPTATGAAKAVGKVLPELNGKLTGMAFRVPTTDVSVVDLTVRLEKPASYDAIKAALKEASQGKMKGILGYTEDDVVSSDFITDSRSSIFDAKAGIALSDTFVKL

SEQ ID NO: 13538 - protein, 585 aa, Oryza sativa (indica cultivar-group)
MAGRGEGNGAATMAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQNYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKEVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 13539 - protein, 215 aa, Ranunculus bulbosus
ALRHEMSVLCDAEVGLIIFSARGKLYEFASAGGMSRTLERYHKNSFSNQDSNLAIDRETQSWYQEVSKLKAKYESLQRSQRHLLGEDLGPLNVKELQNLEKQLEGALAQARSRKTQIMLEQMEALRRKERELGDMNKQLKNKYQLEAEGQGSLRAMQGSWESNALNNYSGHPSHSSSMDCEPTLQIGYHQYVSADGGPIQRNNAGENNFIQGWEL

SEQ ID NO: 13540 - protein, 539 aa, Triticum aestivum
  unsure (1)..(539): unsure at all Xaa locations
MDPYKVCTPPILPQPTRSRQLAGPDRRFGCPCRPAIRSSDALGFPGFLCCSQHRPTSGANSGYWTTNSGAPVWNNNNALTVGQRGPILLEDYXLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 13541 - protein, 214 aa, Bacillus subtilis subsp. subtilis str. 168
MQATVHESKQSIMQRILTVFVFTLLIATVGLFIGQFVPVALMLPLSILEVAMIILAFWMRRRKAVGYAFVYTFAFVSGITLFPIVSHYASIAGAYVVLEAFGSTFVIFAVLGTIGAKMKKDLSFLWSFLLVAVLALAVVGIFNIFSPLNSAAMMAYSVIGTIVFSLYILYDLNQIKHRHITEDLIPVMALSLYLDFINLFINLLRFFGILSSDD

SEQ ID NO: 13542 - protein, 213 aa, Candida tropicalis
ISLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 13543 - protein, 340 aa, Bradyrhizobium japonicum USDA 110
MAAPKKAAASAPQDKTNGGSPPEFTREQELKALRDMLLIRRFEEKAGQLYGMGAIGGFCHLYIGQEAVVVGMQMALKEGDQVITGYRDHGHMLATGMDANGVMAELTGRRGGYSKGKGGSMHMFSKEKHFYGGHGIVGAQVSLGTGLAFANNYRGNGNVSVTYFGDGAANQGQVYESFNMAELWKLPVIYVIENNRYAMGTAVSRASAQQDFSKRGASFNIPGLQVDGMDVRAVKAAGDEAAAWCRAGKGPMILEMQTYRYRGHSMSDPAKYRTREEVEKVRHDQDPIEQVRNRLLTAKVSEADLKAIDAEVRDIVNASADFAQHDPEPDAAELWTDVYR

SEQ ID NO: 13544 - protein, 163 aa, Zea mays
  unsure (1)..(163): unsure at all Xaa locations
ALFIENKQRKDGSWYGTWGICFICGTFFAIKGLIAAGRTYDNXSSIRQACNFLLSKQQATGGWGESYLSSEIGNYINGNTHVVNTAWAMLSLIYAGQVERDPIPLYQAARELINMQLDTGDFPQQEHVGCFNSNFYLNYPNYRNLYPIWALGEFRQRLGAHKK

SEQ ID NO: 13545 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 13546 - protein, 365 aa, Xylella fastidiosa Dixon
MNAQTHTVLDLVRQELRSFAGYSSARSVALTGDLWLNANESAWPNPADSHATMRRYPEPQPPKLRQMLAALYGCLPEQVLIGRGSDEGIDLLVRAVCEPRRDPVLVTPPVFGMYAVSAQLQNAPLIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAVLRRCQAPYPLPTPCVSLAEQGLSAAALHVTAQRVAEIRAERERLRAALACLSGVRRVYPSQGNFLLVRFDDAEAAFQALYAAGVVVRDQRAAPQLHDALRLTVGTPEQNTRLLAVLRDIQAVPA

SEQ ID NO: 13547 - protein, 179 aa, Bradyrhizobium japonicum USDA 110
MTFDHDLKASVRTIPDYPKPGIMFRDITTLLADARAFRRAVDELVNPWAGNKIDKVAGMEARGFIIGGAVAHQLSAGFVPIRKKGKLPHTTVRIAYSLEYGIDEMEMHVDAIQPGERVILVDDLIATGGTAEGAVKLLRQIGANVVAACFIIDLPELGGAAKLRAMDVPVRTLMTFEGH

SEQ ID NO: 13548 - protein, 455 aa, Vanvoorstia spectabilis
VIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWSRKNDMILHLHRAGNSTYSRQKVHGMNFRVICKWMRMAGVDHIHAGTVVGKLEGDPLMIRGFYNTLLLPYLDINLPQGIFFQQEWAALRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 13549 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 13550 - protein, 407 aa, Listeria monocytogenes EGD-e
MIEKRNTIRMEQAREVLCNQITHLPVEKKHVTEALNQVLQEPIFAPFPAPYFRRSGYDGFAITEVDDGNYPITLRVVAEVPCGETYDKPLKPGETVRIMTGAKVPDNASKIIMLEQSREADNENEIILINTQKSSNITEIGTEFAKGDLLLDRGHILNAGSISLLSSFGIQEVQVIRKPKVAILSTGSELVPAGNPLPDGKIFNSNQPLLENLLKVHHAEICAAEQLPDNYEDTKNRLLELTKIADLIVTTGGVSVGDFDYMADIAKQEAELLFNKIQMRPGSPTTGMWLDKTLIIALSGNPGACFTGFYLLVEPVLTTLMGKDTTETTQVRAKMASDYTKNNGYDRFLRGTYRLSDEGEYLVELVGSDMSSALGNLHLTTCLFKIPRGQVGKLKGEEVEAWLLYSK

SEQ ID NO: 13551 - protein, 353 aa, Neurospora crassa
MGCGMSTEEKEGKARNEEIENQLKRDRMQQRNEIKMLLLGAGESGKSTILKQMKLIHEGGYSRDGAESFKEIIFSNTVQSMRVILEAMESLELPLADQRVEYHVQTIFMQPAQIEGDVLPPEVGNAIEALWRDAGVQSCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 13552 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRRFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 13553 - protein, 430 aa, Xanthomonas axonopodis pv. citri str. 306 [sequence omitted]

SEQ ID NO: 13554 - protein, 111 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIK

SEQ ID NO: 13555 - protein, 359 aa, Glycine max
MSYEEHKRLRRLTSSSINGMESLSLYLTYIEENVKNSLEKWANMGQIEFLTEIRKLTFKIIMHIFLSSESEPVMEALEREYTALNHGVRAMCINIPGFAYHKAFKARKNLVAIFQSIVDERRNLRKGYLPGKAKDMMDALIDVEDDDGRKLSDEDIIDIMLMYLNAGHESSGHITMWATFFLQKHPEYLQKAKAEQEEIIRRRPPTQKGLTLKEVREMDFLYKVIDETLRVITFSLVVFREAKSDVNINGYTIPKGWKALVWFRSVHLDPEIYPNPKEFNPYRWNKEHKAGEFLPFGGGSRLCPGNDLAKMEIAVFLHHFLLNYRFEQHNPNCPVRYLPHTRPMDNCLGRVRKCSSTTT

SEQ ID NO: 13556 - protein, 98 aa, Salmonella enterica
IKHAKAINALANPTTNSYKRLVPGYEAPGMLAYSARNRSASIRIPVVASPKARRIEVRFPDPAANPYLCFAALLMGGLDGIKNKIHPGEAMDKNLYDL

SEQ ID NO: 13557 - protein, 321 aa, Oryza sativa (japonica cultivar-group)
MARPLGQQQVGAAAALVIVVACCVVAGCSGARGRGFREEFDVIWGEDHVRVTDEDDAATRQVVALTLDQASGSGFQSKDQFLFGEFSMEMKLVPGESPGTVATFYLTSEGDAHDEIDFEFLGNVSGEPYVMHTNVFAQGRGNREQQFYLWFDPTADFHNYTILWNPLNIIFSVDGKAVRVFKNHEAAGVPYPSGQAMRVHASLWNGDFWATRGGQVKINWTAAPFVASYRTYAYSACAVPAAGGGGGGPCTSGQLPNSTSSPSTCDCGGAWMDRQLGADGERDVAWARANYMIYDYCGDQWRFPQGLPAECSLDQSSGHRT

SEQ ID NO: 13558 - protein, 639 aa, Oryza sativa
MPHVRSAAVKLMEEQLDSSEMDMDEPGGAAAAAADANNGAGSKDCPLPPPPPKTAKACAAAKKPRSVSSDFGEELDLEQLGAKQQQQQQERKLSRQDRVELSRSFQHAVSSHDWDGAEALVRRADAQGLNDVLCVAVDAIWFLSDKEELAAVVALIRRIVSEGANDFTRAALRTSFLASCVSACRGRTTSLADAVSFMGQKLNERLQESHGDEVLKAEASAKVHKFTEWALKCIGLHSRVRENKGRGNHGTIIEVQLQLSAFKTFLDLADNDLTGKDFTEAFDAACFPLTLFSNTFDQGWASGISAAAIQGLLELLVEGGADNVNQCFLEAARYGSTELVRILLQIARRNSLDIDVDLALGFAAHYGKLDTMGCLVEEGNAVAFLGPLMRAAERGCLQVVEWFVNLGCRDMELCLALTAATSSSQVAVAAYLLPLVPKHVLAPLSVEILKAAGERSTGSLHGVDFLLRSNFLNDPAATYAVADNIAKSADEAVDAKLRSFMLEHWSEAAFSEGFASAQEHFVNFMRIMEKGESPICLRDLPLELVIAMAYLPLYRECVESGGRLLPQKLRGQLVEAAGRLEGRQLDRASQGTELLAILEHHLPAVMFLLGDNHLKRWHLEVSESIVTEELSCWRCSESI

SEQ ID NO: 13559 - protein, 621 aa, Zea mays
  unsure (1)..(621): unsure at all Xaa locations
EFGRDGVLTPAISVLSSMSGFKXRATGLKHSSVVLLSCIVLVGLFALQHRGTQKVAFVFAPIVIIWLLSIGGIGLYNILHWNPNIYQALSPYYMVKFFRKTGKDGWIALGGILLSMTGSEAMFADLGHFTSASVRVAFITVIYPCLILQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMFVTTFLMALIIIFVWQRNIIFALVFLVFFGSIEAVYLSSSLMKVTQGGWVPLVLAFIFMSVMYIWHYGLRRKYQFDLQNKVSMRSILSLGPSLGIVRVPGIGLIYTELVTGVPSIFSHFVTNLPAFHEVLVFLCVKSVPVPYVSPDERYLVGRIGPKEYRMYRCIVRYGYKDVQRDDDNFENMLVMNIAKFIMMEAEDASSSASYDVSNEGRMAVITTTDASGSPLAMRDFDGLADSMTMRSSKSETLRSLQSSYEQESPSVSRRRXRVRFEVPEEDGMGRQVKEELMALVEAKHAGVAYIMGHSYIKARRSSSFLKKFAIDVGYSFLRKNCRGPSVTLHIPHISLIEVGMIYYV

SEQ ID NO: 13560 - protein, 305 aa, Escherichia coli O157:H7 EDL933
  unsure (1)..(305): unsure at all Xaa locations
MSAKVWVLGDAGRRSLARIRRAXYCLVLAARQLTLPVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 13561 - protein, 243 aa, Candida glabrata
MSGGAAAASAAGYDRHITIFSPEGRLYQVEYAFKATNQTNLNSLAVRGKNCSVIINQKKVPDKLLDPSTVSYIFKISKTIGMVANGPIPDARNAAARAKGEAAEFRYKYGYDMPCDVLAKRMANLSQIYTQRAYMRPLGVILTFISVDEELGPSIYKCDPAGYYVGYKATATGPKQQELTTSLENYYKKKNVGSHLDMEEWEKVVEFGITQMIDSLGTEFSKKDLEIGVATENKFIILTPDEI

SEQ ID NO: 13562 - protein, 356 aa, Streptomyces antibioticus
MKALVLAGGSGTRLRPITHTSAKQLVAVANKPVLFYGLEAIAAAGITDVGLIVGDTAGEVPRAVGDGAKFGLDITYIEQSRPLGLAHAVLIAHTYLGDDDFVMYLGDNFIVGGIDDLVRTFRDGRRPAARILLTHVSDPSGFGVAELDDDGRVVGLEEKPRHPKSDLALVGVYFFTPAIHEAVRAIEPSWRGELEITHAIQHLIDNGADIQSMVIEGYWKDTGNVADMLEVNRTVLEDLEPRIEGTVDEHTVVIGRVVVGEGARVTNSRIMGPAIIGAGPEISDSYIGPFTSVGDNCRITGSEMEFSIMLAESAITGVRRIEGSLIGRNVQVTQSLHAPNAHRFVLGDHSKVEIQS

SEQ ID NO: 13563 - protein, 321 aa, Zea mays
REAIAPIPRPPADWRGLGCAAAAQAHAPAAAVEAARPTADWRRLGCAAGAAPAVQAQAPRRSEEWRVRRRRNERERRKARAGGVSGGGGASAGMGVGGDVWCTPGIPFAAEASSVDCVVAPHHTVAARRRAEADRPRRERPGAPPARRVTMREHMSSSPLSSPPHHVMPFVDVDRAPSGRIRHVSGRRHSHARVEEEMMFQTRMLLGRMGIYDQYQDWRLDVDNMTYEELLDLEDRIGYVSTGLREDEIIQSLRMVKYSAFNPRHFSTEMDRRCSICQEEFEVHEETGKLSCGHSYHVDCIKQWLSRKNACPVCKTTVSKT

SEQ ID NO: 13564 - protein, 257 aa, Zea mays
MASRKFFVGGNWKCNGTGEDVKKIVTVLNQAEVPSEDVVAEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 13565 - protein, 355 aa, Trichodesmium erythraeum IMS101
MQIVNSQISIEKTSHSRIKEQDINNTPFGKVFSDHMLVATYANNSWQEVKITPYGNISIRPSLSVLHYGQAVFEGLKAYKNYQGKPVLFRLEANYKRINNSAFRLCMPSIPKEIFIDGLKELIRLDTDWIPTKSDSALYIRPIYFATDESVGLKPANSYKFIILSSPTGTFYSAPVKLIVTDKYVRASEGGTGAAKCAGNYAGSFLADKEAKEQGYDNVLWLDGKEKKYIEECGTMNVAFVINDVLITPKLTGSILGGITRDSALTLFRDMGVKVEERLISIDEVAKAYEAGNISEAFGMGTAATIAHISVINYQGKDMILPPVDERKYASQVLQKLEDIKTGKVTDPYGWICQL

SEQ ID NO: 13566 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 13567 - protein, 457 aa, Triticum aestivum
  unsure (1)..(457): unsure at all Xaa locations
MRLIAEQAGGKGSGGRQRVLDVMPTEGHHHGAREDKAGERNSSIRSTKAMAAATTTTSRPLLLSRQQAAASSLQCRLPRRPGSSLFAGQGQASTPNVRCMAVVDTASAPAPAAARKRSSYDMITLTTWLLKQEQEGVIXTTRIITTACQQIASLVQRAPISNLTGVQGATNVQGEDQKTLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLADGYCMYSSSDSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 13568 - protein, 471 aa, Grateloupia intestinalis
SGVIPYAKMGYWDPEYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRAIAATGEVKGHYMNVTAATMEDMYERAEFAKQLGTVIIMIDLVIGYTAIQTMGIWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVISRNEGIDFVAEGPQILQDAAKTCGPLQTALDLWKDITFNYTSTDTADFVATPTANV

SEQ ID NO: 13569 - protein, 206 aa, Michelia figo
  unsure (1)..(206): unsure at all Xaa locations
VQLKRMENKINRQVTFSKRRNGLLKKAYELSVLCDAEVALIIFSSRGKLYEFGSAGTNKTLERYQRCCYTPQDVVVSDRETQGWYQEVSKLKAKYESLQRSQRHLLXEDLGPLSVKELQHLERQLEVALSQARQRKTQIMIEQMEELRKKERQLGDINKQLKIKLEAEGQGPFRCIQGSWESGAMVGNNTFSMNAPQAAPLDAXSP

SEQ ID NO: 13570 - protein, 371 aa, Methanocaldococcus jannaschii
  unsure (1)..(371): unsure at all Xaa locations
MFISYWLLQNVFERHYIKKFLVLSMMKVCVIEGDGIGKEVIPEAXKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 13571 - protein, 485 aa, Grateloupia turuturu
NSVERTRIKNERYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEEMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDYVAEGPQILQDAAKTCGPLQTALDLWKDITFNYTSTDTADFVETPTTNV

SEQ ID NO: 13572 - protein, 105 aa, Oryza sativa
FCLLVQSDLYPLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 13573 - protein, 346 aa, Prochlorococcus marinus str. MIT 9313
MTGTNPVHSNEPEVICLGEALVDRLGPLGGDPAVDQPVEDCLGGAPANVACGLARLGSKVAFLGRLGDDAIGARFRELFNTRGVNLAGLQIDQRRPSRIVLVRRDLDGERVFQGFAGDRGDGFADPALSLDELAASWPLLVGKASWLLIGSIPLATPASAQALLWCVEQAQTAGLEIALDVNWRPTFWDPGHSPDSGPDEKALQAIAPLLERASLLKLAREEAVWFFDTDDPAVIARSLPQQPDVVVTDGARPVRWWIGGCVGELAALSPPSVVDTTGAGDAFTAGLLHQFLMDASSQRDLIKAREMVRFAAACGALVCGGAGGIDPQPSQMQVEEFLGSFEGEVN

SEQ ID NO: 13574 - protein, 477 aa, Onikusa pristoides
KSQRYESGVIPYAKMGYWDPDYAVKETDVLALFRVTPQPGVDAVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGDDVVLQFGGGTIGHPDGIQAGATANRVALEAIVIARNEGRDYVAEGPQILRDAAKTCGPLQTALDLWKDISFNYTSTDTADFVETPTANV

SEQ ID NO: 13575 - protein, 499 aa, Dechloromonas sp. RCB
MKRLLALLALVGAVGFGAPAWAEEKAAAPEAVAATAPAAAPAAAAPAAAPAAAAPAAAPAAAPIPPNKGDNAWVMISAALVILMSIPGLALFYGGLVRTKNMLSVLMQVFVTFSLISVLWVVYGYSAAFTEGNEFFGVLDKLFLKGVTVDSVAATFSKGVNISEFAYVIFQGAFAAITCGLIVGAFAERAKFAAILVFMVIWFTLSYIPMAHMVWYWAGPDAYIDAAAGELAGKTAGFLFQKGALDFAGGTVVHINAAIAGLVGAYMVGKRSGLGNVSMAPHSLTLTMIGASLLWFGWFGFNAGSALEASGGAALAMVNTWVATACAALSWMFAEWILKGKPSMLGAASGAVAGLVAITPAAGFVGVMGSIIIGLLAGVVCLWGVNGLKKLLGADDSLDVFGVHGVGGILGAMLTGVFADPALGGTGVYDYVANAVGPYDMTAQLISQAWGVGTVIVWSGVVSIVAYKLVDIVIGLRVPEEEEREGLDLTSHGETAYHH

SEQ ID NO: 13576 - protein, 257 aa, Glycine max
MEVLVGPAFTIDVPSSPPQHAGSDDRIFLNVSPEEGDGSNFRISGPPKFFAGGESESSSSIGTPDDSDNEEEEEVQSQLKIRTGLGSLDALEESLPIKRGLSSHFDGKSKSFSDLSQMSNLSNLKELQKQESPFNKRRRVLIASKWSRRSSFYSWSNPQSMPLLPVDEDQDYDYEEEEEEEDDEEKARKVPSASSSSSSSLAEEKKQEDQVQLRLNRVPESYAAHMRLRLGSFKARSFSLADLQEHDDEEEDDDRLN

SEQ ID NO: 13577 - protein, 772 aa, Hordeum vulgare subsp. vulgare
MVVVSQGQWKYHKALSLLAFQSFGVVYGDLSTSPLYVFKSALSGLDDYSDEATVFGLFSLIFWTLTLIPLLKYVIIVLAADDNGEGGTFALYSLLCRHAKMSLLPNQQAADEELSTYYQPGVDRTAMSSPFKRFLEKHKKLRTCLLLFVLFGACMVIGDGVLTPTISVLAALSGLQDKDTGGLGNGWVVLIACVVLVGLFALQHRGTHRVAFAFAPIVVLWLLSIGIIGLYNIIRWNPRVCLALSPHYIVKFFKITGRDGWISLGGVLLAVTGTEAMFADLGHFTAASIRLAFVGVIYPCLVLQYMGQAAFLSKNMDAVHDSFYLSIPRTVFWPMFVLASLAAIVGSQSIISATFSIVKQCLSLGCFPRVKVVHTSRWIYGQIYIPEINWILMCLCLAVTIGFRDINIIGNAYGLVCITVMFVTTWLMALVIIFVWKKNIMIALLFLIFFGSIEGAYLSASFIKVPQGGWTPIALAFVFMFIMYVWHYGTRRKYLFDLQNKVSMKWILTLGPSLGIVRVPGIGLIYTELVTGVPAIFSHFVTNLPAFHQILVFVCVKSVPVPYVPADERYLIGRIGPRQYRMYRCIVRYGYKDVQKDDENFENHLVMSIAKFIQMEAEEAASSGSYESSNEGRMAVIHTTDATGTGLVMRDSNEGTSLTRSSKSGTLQSLQSIYEQESGSLSRRRVRFQIAEEEQVNPQVRDELSDLLEAKEAGVAYIIGHSYVKARKNSNFLKSFAIDYAYSFLRKNCRGPSVTLHIPHISLIEVGMIYYV

SEQ ID NO: 13578 - protein, 1230 aa, Cryptococcus neoformans var. neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 13579 - protein, 220 aa, Chlorobium tepidum TLS
MPGKTTLLAPSILSADFTNLKASVELAEKAGADWMHCDVMDGIFVPNITFGSFIVQAIKQCTSIVIDTHLMIVDPDKYIEDFAKAGSDQITVHLEACPHLHRTIQLIKSLGVKAGVSINPATPVSLLEPVLADLDLVLLMSVNPGFGGQKFIPGAIKKIMQLDAMRMEMNPEMVIAVDGGVTEENAAMIVDAGADALIAGTAFFRAPDPVAAAKKLKGLE

SEQ ID NO: 13580 - protein, 373 aa, Populus tremula x Populus tremuloides
MPSRSLADAFRSHPVHLHQKHLDFSSLQEIPDSHKWTQLDDIEQQHPSVESFITESVPVIDLLDPNVLQNIGNACKTWGVLQVTNHGIPISLLESVEGVSRSLFSLPVQQKLKAARSPDGVSGYGVARISSFFSKLMWSEGFTIVGSPLEHFRQLWPQDYTKFCDVIEEHEKEMQKLARRLTWLMLGSLGITKKDLNWAGPKGESKEGGAALQLNSYPACPDPDLAMGLAAHTDSTLLTILYQNNTSGLQVLKEGIGWVTVPPIPGGLVVNVGDLLHILSNGLYPSVLHRAVVNRTKHRLSIAYLYGPPSSVQISPIQKLVGPNHPPLYRPITWNEYLVAKAKHFNKALSSVRICAPLNGLVDVNDHNSVKVG

SEQ ID NO: 13581 - protein, 294 aa, Yersinia pestis CO92
MQARFHTSWAELPASLQFALEPILSAENFPAMLTAEQVKTVKNISGLDDDALAFALLPLATACALTPISHFNVGAIARGKSGNFYFGANMEFRGVPLQQTIHAEQCAVTHAWLRGETNLVAITVNYTPCGHCRQFMNELNSGSELHIHLPGRPPSTLGQYLPDSFGPTDLAITTLLMDPVNHGYTLAETDPLTQAALNAANHSHAPYSQSHSGVALETTNGKIYAGRYAENAAFNPSLPPLQAALILANITGENCASIRRAVLVEGHNAVTSQWDTTLATLNALGCSAVKRVTF

SEQ ID NO: 13582 - protein, 293 aa, Vibrio cholerae
MKGIILAGGSGTRLYPITRGVSKQLLPIYDKPMIYYPLSTLMLAGIRDVLIITSPEDNESFKRLLGDGRDFGVHLQYAIQPSPDGLAQAFLIGEEFIGNDSVCLVLGDNIFYGQSFSKTLRHAASREHGATVFGYQVKDPERFGVVEFNEQMRAVSIEEKPLKPKSNYAVTGLYFYDSRVVELAKQVKPSARGELEITTLNEMYLNDGSLNVELLGRGFAWLDTGTHESLHEAFLLCRNGAAHFKGLKIACLKEIAWRNGWLTSEQLLECAKPMLKNDYGQYLERLVKEERHG

SEQ ID NO: 13583 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDATYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 13584 - protein, 392 aa, Xanthomonas axonopodis pv. citri str. 306
MHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPEDLAKFDFDPLDATKIWPDVPEQKVGQMVLNKNVDNFFQETEQVALAPANLVPGIEPSEDRLLQGRIFSYADTQLYRIGANGLSLPVNRPRVAVNNGNQDGQGNIGQTTSGVNYEPSRLEPRPQDTAARYSELPLSGTTQQAKITREQNFKQAGELYRSYSKKDRADLVQSFGESLAATDTESKHLMLSFLYKADPEYGTGVTRVAKGDLARVKQLASSLQD

SEQ ID NO: 13585 - protein, 591 aa, Streptococcus pneumoniae
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAISKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFAFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSLDVGSTTQTSTRHLHMTPKNMWRTSPLFATMGIALPGGIAAKKDTPDRQVWNIMGDGAFNMCYPDVITNVQYDLPVINLVFSNAEYGFIKNKYEDTNKHLFGVDFTNADYGKIAEAQGAVGFTVDRIEDIDAVVAEAVKLNKGGKTVVIDARITQHRPLPVEVLELDPKLHSEEAIKAFKEKYEAEELVPFRLFLEEEGLQSRAIK

SEQ ID NO: 13586 - protein, 448 aa, Streptococcus mutans UA159
MAITAADIRREVKEKNVTFLRLMFTDILGTMKNVEIPATDEQLDKVLSNKAMFDGSSIEGFVRINESDMYLYPDLNTWTVFPWGDENGAVAGLICDIYTAEGEPFAGDPRGNLKKALRHMESLGYKSFNLGPEPEFFLFKMDEFGNPTTEVNDKGGYFDLAPTDLADNTRREIVNVLTKMGFEVEASHHEVAIGQHEIDFKYADVLTACDKIQLFKLVVKTIARKHGLYATFMAKPKFGINGSGMHCNMSLFGSDGKNAFFDPQDPKGMQLSEVAYQFLGGLVKHAYSYTAIMNPTVNSYKRLVPGYEAPVYIAWAGRNRSPLIRVPASRGVSTRLELRSVDPTANPYLALAVLLESGLDGIENKIEAPAPVESNIYVMTVEERKEAGIADLPSTLHNALKALQEDEVVKAALGNHIYTSFLEAKRIEWSSYAAFVSQWEVDNYLDLY

SEQ ID NO: 13587 - protein, 497 aa, Oryza sativa (japonica cultivar-group)
MASPTRPGPYMPRPPAVPEWLNTGDNGWQLAAATFVGLQSMPGLVVLYGSIVKKKWAVNSAFMALYAYASTLIVWVLVGFRMAFGDRLLPFWGKAGAALTEGFLVARASVPATAHYGKDGALESPRTEPFYPEASMVLFQFELAAITLVLLAGSLLGRMNIKAWMAFTPLWLLFSYTVCAFSLWGGGFLYQWGVIDYSGGYVIHLSSGIAGFTAAYWVGPRLKSDRERFSPNNILLMIAGGGLLWLGWAGFNGGAPYAPNITASIAVLNTNVSAAASLLTWTCLDVIFFGKPSVIGAVQGMMTGLVCITPGAGLVHTWAAILMGICGGSLPWFSMMILHKRSALLQKVDDTLAVFHTHAVAGLLGGFLTGLFALPDLTAVHTHIPGARGAFYGGGIAQVGKQIAGALFVVVWNVVATTVILLGVGLVVPLRMPDEQLKIGDDAAHGEEAYALWGDGERFDVTRHEGARGGAWGAAVVDEAMDHRLAGMGARGVTIQL

SEQ ID NO: 13588 - protein, 961 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIASLSSHLRRALVSFHPLTLVTRPEEHIDNPLGYADGKDAREFDPRLRGPVHPGELEIDLYSGMKNYIANERLAYQQGWNTTSAGYIRFSLERCIHFGRLYTSGSRGRGKESDLCEALRCLGQALHTLEDFPAHSNYCELVLIDMEERRGGHSPVFPHVGTDTRITLRNDTRNNGKSVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLAPFLRPIINQVTQVLKEGSSGLIATSAKQQLEPWNNPQCDNPTHSMLSKDHFTNILNSCAGRVAANIVQYVVPRVVYAWENPGVPDSEVIADVLQVFHHPANYKEEVEIQRTMYETVVQWSRETHHDYKTLLASESVKEGHNHVLNGQPMDRGPGGGHTSCGADGGHGKVAGSLWSKIQSRDLDTSAPSGGVGGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSSQPSYGAPPSQPPYGSQPHYGGPPHSSYSGGRPPSPPRPSGYGGGYAGYSAGPPPSHGGYGGSPHGGAPYPHGGAVGGGGSAPYPHGGRADAYERNYDQHYERDERRGGRDGRRRRGSHGSRSSSEERDGRGYPGQGSRGSGHHGGGGGYGGGYGGGYGGGYGGGYGGGGGYGGSYGGRDEHRRY

SEQ ID NO: 13589 - protein, 344 aa, Nostoc sp. PCC 7120
MVQERTIPKFNTANAKITKEEGLLLYEDMTLGRFFEDKCAEMYYRGKMFGFVHLYNGQEAVSTGVIQAMRPGEDFVSSTYRDHVHALSAGVPAREVMAELFGKATGCSKGRGGSMHMFSAEHGLLGGYAFVAEGIPVAAGAAFQSKYRREVLGDPNADQVTACFFGDGAANNGQFFETLNMAALWKLPIIFVVENNKWAIGMAHDRATSDPEIYKKASVFNMVGVEVDGMDVLAVRAVAQEAVARARAGEGPTLIEALTYRFRGHSLADPDEMRSKAEKEFWFSRDPIKKLAAYLIEQNLADEAELKAIERKIQDVIDDAVKFAESSPEPDPSELYRFVFAEDE

SEQ ID NO: 13590 - protein, 493 aa, Zea mays
  unsure (1)..(493): unsure at all Xaa locations
MSEMDQKQGEKNDDIPLCPPHLGFIGGLCFLCGAKEEDAEGGTPRVAVGQGVEGSDSSDDDARCVEAKTEGCAPGVSVGHRMKVEEGDDDALFPLDPEFALAELYYQCGVPGEMIEEEDAEGSASGVTVANIDGGLVRPALAAAMSIGSASDMATLMRERKLILVLDLDSTLVNSARLCDFSAQEKRNGFTRYTGDKPHMDLFRLKYSNKARKLTKLRPFVRGFLEQASSMFEMHVYTLAKRAYAKAVIDLLDPNGVYFGGRVVSRKDSTRRDMKSLDVIPGADPVAVVILDDTDVWAXHQDNLILMDRYHYFASTCRKFRYDIPSLAEQGRDEREQDNSLAVVLNVLRRIHQDFFDGDQADVREVIREVRRQVLPECTVAFSYLDDCMEDFPENTLMWTLAERLGAVCRKDVDETVTHVVAEDPGTQKAQWARDHGKFLVNPEWIKASGFRWCRVDEQGFPVTAGPCELNIVSLQLAVRNGIVSLRAADCPC

SEQ ID NO: 13591 - protein, 154 aa, Zea mays
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 13592 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRQFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 13593 - protein, 473 aa, Triticum aestivum
MDVPLASKTFPSPSPSKREQCNIDGHKSSSKHADLNPHVDDSVLGIILGGGAGTRLYPLTKKRAKPAVPLGANYRLIDIPVSNCLNSNISKIYVRTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 13594 - protein, 321 aa, Triticum aestivum
  unsure (1)..(321): unsure at all Xaa locations
MSQSSPFFSIAPAHAGAGGQAAAAALLLRCPAAQLPPAIHCFRLAKVSPAKTLSSHLVLPRATLSSFANADDGSGANSDASGEQSGGSELSEMAKAFHISPRMAMSISVVIAFAALTVPLAMRSLLFHGTTKMKVLAYLTLLSGFYMAWNIGANDVANAMGTSVGSGALTLRQAVLTAAVLEFSGAFLMGTHVTSTMQKGILVTSVFQGNDSLLFAGLLSSLAAAGTWLQVTFHHRXSFELCYTXVNQMTRSRGSTGRVGGRFWSSLARVSSSWLISPLMGAAVSFLVYKCIRRFVYSAPNPGQAAAASAPIAVFTGVTAI

SEQ ID NO: 13595 - protein, 474 aa, Pachymenia carnosa
RYESGVIPYAKMGYWDPDYVVKDTDVLALFRVTPQPGVDAVEASAAVAGESSTATWTVVWTDLLTACDLYRAKAYKVDAVPNSSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEEMYERAEFAKQLGSIIIMIDLVIGYTAIQTMGIWARKNDMILHLHRAGNSTYSRQKSHGMNFRVICKWMRMAGVDHIHAGTVVGKLEGDPLMIRGFYNTLLYTHLEVNLPQGIFFEQDWASLRKVTPVASGGIHCGQMHQLLDYLGNDVVLQFGGGTIGHPDGIQAGATANRVALEAIIIARNEGRDYVGEGPQILQDAAKTCGPLQTALDLWKDITFNYTSTDTADFVETPTANV

SEQ ID NO: 13596 - protein, 233 aa, Wigglesworthia glossinidia endosymbiont of Glossina brevipalpis
MNNNFFISPSILAANFANLGEEIRKVIDAGADIIHFDAMDNHYVPNLSIGPIVLKSIRKDGIIIPIEVHLMAKPIDELVVSFIKTKANCIIFHPESTKNVNFLLKLIRKNNCKAGLAFTLTTSLNYLKNKNIVKNLDIVLIMSVSPGFSGQKFQKSAIKRLKIARKLIDDSGYNILIGIDGGVNDDNIYDVAYAGADIFVIGSSIFSKNNYFKTIKNMKKKIKSAKINILKNL

SEQ ID NO: 13597 - protein, 163 aa, Triticum aestivum
  unsure (1)..(163): unsure at all Xaa locations
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVXXXXXXXXXXXXXXXXXXXXXXXXXEVEEVKKEYPDAYVRIIGFDNMRQVQCVSFIAFKPPGCEESGKA

SEQ ID NO: 13598 - protein, 323 aa, Dechloromonas sp. RCB
MLALAALIPHATMAADPTPDASQVVAAVEGVFGVTPGERRNHIKGTCAAGEFVGTKEAAKLSRSPLFSGKPVPVVARFSLSGGNPKAPDVAKSARGMALQFQLPKGQLHHITMLNTPMFGAANPQTFLDLMQALQPDPATGKPDPEKMKAFKASHPDNQAQAQYLASNNPPASYASSSYWGIHTFKFVDKKGKATLVRWQFVPQDGEKRLSDDELKTAGANFLESALIERAKQGAVRWDMMVSIGQPGDSETDPTVLWPAERPRIKAGTLTIRSAEAQKGAPCEPINFDPLVMAPGIQPTDDPVLRFRSPAYAVSFGKRLSER

SEQ ID NO: 13599 - protein, 203 aa, Glycine max
MQPFTPKSPPTIPTATSSTVDHNHNRPSPAAMSSTPNFDNDRSTVTPQNPFPSLGPEPEPADLATAFASQRFFFTSPGRSNSIIESANTTDADCFTTSSSSLSPALLDRSVAVRKYSPDPYADFRQSMEEMVAARPELMDVAAKWRELHELLLCYLALNPKSTHKFILRAFSDFLLSLISRSYLPPQDPGSGDIAGDGGGCLS

SEQ ID NO: 13600 - protein, 417 aa, Zea mays
MDWSTRFRTRNPSPAVSHFAGHRRSQADRVFLRTMASAAPVEEPTAAAEAKGRLTGDSFIRRHLRTLAPYQPILPFEVLSARLGRRPEDIIKLDANENPYGPPPEVAAALGSLKFPYVYPDPESRQLRAALAEDSGLESDYILAGCGADELIDLIMRCVLEPGDKIVDCPPTFTMYEFDASVNGALVIKVPRLPDFSLDVDLIVEVVEQERPKCIFLTSPNNPDGSVINDEDLLKILDLPILVVLDEAYIEFSSLQSRMAWVKKHDNLIVLRTFSKRAGLAGLRVGYGAFPLSIIEYLWRAKQPYNVSVAAEVSACAALQNPTYLENVKNLLVKERERLFNLLKGIPFLKPFPSHSNFILCEVTSGKDAKKIKEDLAKMGVMIRHYDKKELKGYIRISVGKPEHTDALMKGLNALRL

SEQ ID NO: 13601 - protein, 365 aa, Arabidopsis thaliana
MESRCKKGYFRLAVIGLSKAKDCWEKNACAVTFIGDGGTSEGDFHAGLNFAAVMEAPVVFICRNNGWAISTHISEQFRSDGIVVKGQAYGIRSIRVDGNDALAVYSAVCSAREMAVTEQRPVLIEMMIYRVGHHSTSDDSTKYRAADEIQYWKMSRNSVNRFRKSVEDNGWWSEEDESKLRSNARKQLLQAIQAAEKWEKQPLTELFNDVYDVKPKNLEEEELGLKELIEKQPQDYMMLKELIPNWILGIGTLALRYDFQETLFNGWHAIAELQQLKLKIKLNSLLNDQADTESLKAARNSALNVIQAMIIHLVLTLKGRFSLPLTEETVRFNEPIQLNQNMVKDGGYTAELFPIRKEEQGEVRR

SEQ ID NO: 13602 - protein, 756 aa, Haemophilus influenzae Rd
MTEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKEYAIEDNGWRKLADAIPNADIFLGCSAAGALTQDMVKSMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 13603 - protein, 456 aa, Porphyra umbilicalis
YVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGELKGHYLNVTAATMEDMYERAEFSKVVGSVICMIDLVIGYTAIQSMAIWARKNDMILHLHRAGNSTYSRPKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 13604 - protein, 468 aa, Carpomitra costata
  unsure (1)..(468): unsure at all Xaa locations
IPYAKMGYWDADYNVKETDILALFRITPQPGVDPVEAAAAVAGESSTATWTVVWTDLLTACDIYRAKAYRVDPVPGTSDQFFAYVAYECDLFEEGSLPNLTASIIGNVFGFKAVKALRLEDMRIPFAYLKTFQGPATGVIVERERLDKFGRPLLGATVKPKLGLSGKNYGRVVYEGLCGGLDFLKDDENINSQPFMRWRERYLYCMEGVNRAAAATGEVKGSYLNVTCATIEEMYERADYAHSIGTVIVMVDLVIGYTAIQTMAIWARKADMILHLHRAGNSTYARQKNHGXNFRVICKWMRRXGVXHIHAGTVVGXLEGDPLMVRGFYNTLLLTELKIITLYGIFFDMDWASLRKCVPVASGGIHCGQMHQLLYYLGDDVVLQFGGGTIGHPDGIQSGATANRVALEAMVLARNEGRDYVGEGPEILRHAATTCGPLKAALDLWKDITFEYTSTDTPDFVEVATESK

SEQ ID NO: 13605 - protein, 442 aa, Schizosaccharomyces pombe
MSTVKTFSSTETEGFKKRLLSRRHSSYQVRDEEDDVLEEFIVLKLDLFLTRLNHRMKRLEELGLPNRKDAAAATYQFLANLQASFLGTTILGKTQVSFILRRIEETYNDVLSACDTFPAKAQKALTFLEHHLRDLEDYAEKSKNNVETLMTDIKDVVEHAAKLGAQRLITLEELPVQWHNNPYIIRGYRFYTSKRKCFRSILSWHNETFNIWTHLSAFIVFFAVLAYFYPSSSSWVSSNVSNRIVRIFFLLSAMKCLGCSVIWHTFSSLSNYKHMRCAACMDYVGISALIAASIISVEYHAFVCQGPLRFIFIAFTGTLGLIGIYTPWKKWFNEYKYRSVKIFFFVGLACSGLIPMITMFYIKGTRRTVKYLDPVFKSIFSYIIGVLFYGLHIPERFLPGKFDIIGNSHQIWHIAIIVGVAFHYTGVKRFETDYEAFSCGVL

SEQ ID NO: 13606 - protein, 354 aa, Pisolithus sp. 441
MGCVQSTGVDGDAKARNDEIENQLRRDKMLAKNEIKMLLLGAGESGKSTVLKQMKLIHHGGYNDSERDSYKEIIFSNTIQSMRAILEAMPQLDISLSPQNDARRAVILALPIQIEGDVLPRDVADAIRGLWKDPGVKEAVRRSREFQLNDSAVYYFNAIDRMAAPGYLPTDQDILRSRVKTTGITETTFKVGELTYRLFDVGGQRSERKKWIHCFENVTALVFLVSLSEYDQMLYEDESVNRMQEALTLFDSICNSRWFVKTSIILFLNKIDLFAEKLPTSPLSDYFPDYTGGENYDAACDYLLHRFVALNQNAATKQIYAHYTCATDTQQIKFVLSAIQDILLQIHLRECGLL

SEQ ID NO: 13607 - protein, 391 aa, Staphylococcus epidermidis ATCC 12228
MRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 13608 - protein, 335 aa, Triticum aestivum
  unsure (1)..(335): unsure at all Xaa locations
MAGQGSYSRLAADEAAAVISGGGGDDDDAKKLRLLGYEPQLKRNLSLLSNFSVTFSIVSVLTGITTLYGTGPQFGGPVAMVYGWPIAGAFAAPVGLAYGGPFAASPTFGGRLVLAARRCADPPSGPSPPRLSGWFNIVGQWAVTTSADYSLAQLIQVIILLSTGGNNGGGYLASKYEVIAIHAAILLSHARINXSLPIAWLSFFGQFAAAWNMLGVFVLMIXXPXXVPKRXRANXVFTNLNTXDNSAGIHSHXYIFLLGLXMSQYTLLXYDASXHMTEETKNAXKNXPIGIISAIGISNRWRXGIILXVPLPXKDIPSLLSPDXKAGGTPSPYRP

SEQ ID NO: 13609 - protein, 288 aa, Magnetospirillum magnetotacticum
MKFSSMLVFMSLWLLVVYAPICHWVWMLDEKGGAVGFLAKLGVLDFAGGTVVHINAGIAGLVACLILGPRKGYGTDNMAPHNLSLSIIGASLLWVGWFGFNAGSAVAADGRAGMAMAVTQVGAAAAAVSWMLAEWVLRKKPSALGIISGAVAGLVAITPASGFVDVKGALVIGLVAGVLCYWGATGLKHALKYDDSLDAFGVHGIGGIIGAILTGVFAVEKIGGTAGLLEGNGAQVMTQVYGVLTTLVYTAVVSFILLKAIDMVMGLRVTAEEEREGLDIALHGETVH

SEQ ID NO: 13610 - protein, 383 aa, Glycine max
  unsure (1)..(383): unsure at all Xaa locations
MAASLQLFQCKLARPFRSFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPLVDASTLKREVAEGVDIMLIRELTGGIYFGEPXGFGTNENSDVFSSSTDTYAIHELXFFALQASMLWRKRFLAIAQEYPDVELSHMYVDNASMQLIRNPKQFDTMVTNNIFGDILSDEASMVTGSIGMLPSASLGASGPGLFEPIHGSAPDIAGQDKANPFATVLSAAMLLRYGLGEEKAAKRIENAVVDTLNRGFRTGDIYSAGTKLVGCKQLGEEILKSVESNVHAGAATV

SEQ ID NO: 13611 - protein, 448 aa, Oryza sativa (japonica cultivar-group)
MGQGTPGGMGKQGGAPGDRKPGGDGDKKDRKFEPPAAPSRVGRKQRKQKGPEAAARLPNVAPLSKCRLRLLKLERVKDYLLMEEEFVAAQERLRPTEDKTEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 13612 - protein, 438 aa, Pseudomonas stutzeri
MTLRRFAGLGALLSLLSPGLAMAQEATLDSGDTAWMLTATALVLFMTIPGLALFYGGMVRSKNILSVMMQCFAITGLMSILWMVYGYSLAFDTTGMEAGVTNFNSFVGGLDRAFLSGLTPDSLVGAFPESVFITFQMTFAIITPALIVGAFAERMKFSAMLVFMDVWFTLVYAPIAHMVWGGDGGLMWDWGVLDFAGGTVVHINAGIAGLVACLVLGKRKGFPTTPMAPHNLGLTLVGAAMLWIGWFGFNAGSAVAANGTAGMAMLVTQIATAAAALGWMFAEWIGHGKPSALGIASGVVAGLVAITPAAGTVGPMGALIIGLVSGVVCFFCATSLKRKLGYDDSLDAFGVHGVGGIVGALLTGIFAAPMLGGFGEVENIGLQLWIQFKGVLFTVVYTGIVTYLILKAIDLVMGLRVNEEQETIGLDLSLHNERGYNL

SEQ ID NO: 13613 - protein, 175 aa, Oryza sativa; identical to SEQ ID NO: 2331

SEQ ID NO: 13614 - protein, 368 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADGTIKTRGHFRTCDCDETCCNIQTSG

SEQ ID NO: 13615 - protein, 245 aa, Zea mays subsp. parviglumis
SIRNNPVQNKLMNSEDPINNNHAQTAGGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPVPVPPPIRDSIVGYFSAPAADDDASVGNGFLRLQAQEPASMVVGATLSATEMNRVAAATHCAGAMELIQTAMG

SEQ ID NO: 13616 - protein, 145 aa, Streptococcus pyogenes M1 GAS
METSDELKQRIGDLSYEVTQHAATESPFTGEYDNFFEKGIYVDIVSGEVLFSSLDKFNSGCGWPAFSKPIENRMVTNHDDSSYGMRRVEVKSREAGSHLGHVFSDGPKEAGGLRYCINSAALKFIPYDQMEKEGYAQWLTLFDET

SEQ ID NO: 13617 - protein, 174 aa, Magnetospirillum magnetotacticum
MNIKDHIRGVPDFPKPGILFYDISTLLAHPDAWQVAMGRMAREIIKFQPDVLAGIESRGFLVAAPLALKLGCGFVMLRKNGKLPGETIRHDYELEYGTDTIEIQKNAIAEGSRVVILDDLLATGGTMAAGVQLLRKIGAHVTGAGTIIDLAFLPGKQRLKELDVPFTCLASYDD

SEQ ID NO: 13618 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 13619 - protein, 409 aa, Streptomyces coelicolor A3(2)
MAAEIVNPRSDSEAGAEQEAGAEPLDSFDPAFALHRGGKMAVQATVPIRDKEDLSLAYTPGVAKVCSAIAEQPDLVHDYTWKSSVVAVVTDGTAVLGLGDIGPEASLPVMEGKAILFKQFGGVDAVPIALNCTDADEIVETVVRLAPSFGGVNLEDISAPRCFEIERKLQERLDIPVFHDDQHGTAVVTLAALRNAARLSGRTLGELRAVISGAGAAGVAIAKMLVEAGIGDVAVADRKGVVSADREDLTPVKQELASFTNKAGLSGPLEAALAGADVFIGVSGGTVPEPAVASMAEGAFVFAMANPNPEVHPEVAHKYAAVVATGRSDFPNQINNVLAFPGIFAGALQVRASRITEGMKLAAAEALASVVGDDLAADYVIPSPFDERVAPAVTAAVAAAARAEGVARR

SEQ ID NO: 13620 - protein, 363 aa, Caulobacter crescentus CB15
MARITLRQLLDHAAEHEYGLPAFNINNMEQGLAIMEAADAVNSPVIIQASRGARNYANDIMLAKMIDALVDIYPHIPVCMHQDHGNGPATCATAIQYGFTSVMMDGSLMEDAKTPASYEYNVEVTRKVVQMAHSCGVSVEGELGVLGSLETGMGEAEDGHGFEGKLSHDELLTDPDQAVDFVAQTGVDALAIAMGTSHGAYKFTRKPDGDVLAMNVIEEIHRRLPNTHLVMHGSSSVPQDLQDIINQYGGEMPQTWGVPVEEIQRGIKHGVRKINVDTDNRMAITGAIRKLLVEKPGEFDPRAYLKPAKEAMRKVCQARFVEFGSAGHADKIKPMSTATMAKRYASGELHAKFGASAAKAAAE

SEQ ID NO: 13621 - protein, 201 aa, Carboxydothermus hydrogenoformans
GIDPGPIARASLFSLFRNFKSGEKVVLKIKRPDIEETIKTDLEVIKKYLLPQLRALGFISHFDLNKIFNLFEIKLKEELDFLNELQNLKIFHRALKNYEDLIIPKAFKELSGRNVLVMEYVDGNLLKNFLEQKVYYPTLGEKLIHNFCRLLFWERIFHADPHPGNIIFTKNKKLCFLDLGAVGFVDQRTVEILARTIYFIY

SEQ ID NO: 13622 - protein, 278 aa, Zea mays
  unsure (1)..(278): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFXGVNTYTLITRDGKXPHLVKFHWKPTWGGEMLARHETVTVGRPCHSPATKIYLIHCTGKYPEWEPYSQPLISP

SEQ ID NO: 13623 - protein, 289 aa, Vicia faba
HHSPLPQSPQHGYCCCRRSSLFSSSINTVKSSRSSNRMFASVVIPQSSVEPLCIGTTISSQKLWMPRFYVAVAQEEAVVAVDDEEKVVVEEEEKENEEGQGEKENGEEIVAEEDTRTKLYFGNLPYSVDSAKLAGLIEEYGSAELVEVLYDRDTGKSRGFAFATMTCVEDCKAVIENLDGKEFMGRTLRVNFSDKPKAKESLYPETEYKLFIGNLSWKVTSEILTEAFQEHGTVVGARVIYDGETGNSRGYGFVSYANKSEMEAALTIMNDVELEGRALRVSLAQGKRS

SEQ ID NO: 13624 - protein, 297 aa, Zea mays
  unsure (1)..(297): unsure at all Xaa locations
MAFNYHDHALAMDPANPSFVSGGGMAGGPGWEREKAAIAAHPLYERLLEAHVACLRVATPVDQLPRIDAQIAARPPPMEAAAAAAAAGTXGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKGNWHNNSASSSSDKSKRKR

SEQ ID NO: 13625 - protein, 379 aa, Zea mays
MAKLGPGQGLGCEAAEGSLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKTFIESPWPTNEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSSRN

SEQ ID NO: 13626 - protein, 355 aa, Metarhizium anisopliae
MSRSNPPNAGGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPTPEEFFDFDKHKDTLSKEQLKQLIYQEIMR

SEQ ID NO: 13627 - protein, 354 aa, Pseudomonas fluorescens
MKIRSQIGMVLNLDKCIGCHTCSITCKNVWTSREGMEYAWFNNVESKPGIGYPKEWENQDKWKGGWIRNANGTINPRIGGKFRVLANIFANPDLPSLDDYYEPFDFDYQHLHTAPLGEHQPTARPRSLISGKRMEKIEWGPNWEEILGTEFAKRRKDKNFDKIQADIYGEYENTFMMYLPRLCEHCLNPTCAAACPSGAIYKREEDGIVLIDQEKCRGWRMCISGCPYKKIYFNWKSGKSEKCIFCYPRIEAGMPTVCAETCVGRIRYLGVLLYDADRISEVASTANEQDLYEKQLEIFLDPNDPAVIRQALADGVPQSVIDSAQRSPVYKMAVDWKLALPLHPEYRTLPMVWY

SEQ ID NO: 13628 - protein, 331 aa, Oryza sativa (indica cultivar-group)
MEANLPPGFRFHPRDEELIVDYLYHKLSGGGGGGGAGEFYGGVAMVDVDLNKCEPWELPAYFLHNLIIFPARARARAAGRRRRADAARVGATEWYFFSLHDRKYATGQRTNRATRSGYWKATGKDRAIVTRRRAAGGEAVAGGEVVGMRKTLVFYQGRAPRGSKTEWVMHEFRVDGHAVADHPSSSTSSSSSNLLKEDWVLCRVFYKSRTANPRPVVSGEAAVSLSGELSLPPPPPLPVAPAVIDGYTGGGYYEQDSSAGCHHHHHRPPTSAALPFKDLTDFRDLLSNMVQGGGAAAAAAKSEGFHLGWSEEESSGYVQQSAMASQAWNPF

SEQ ID NO: 13629 - protein, 551 aa, Oryza sativa
MDMDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFWRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKV

SEQ ID NO: 13630 - protein, 222 aa, Listeria monocytogenes EGD-e
MKMIAASIMCADSLHLADELRALEQANVKMLHCDVMDGVFVENAAMGAYVLQDIKNNTKMLLDIHLATVNPDKFVDLYAAIKPAYMSFHLEASRDVNATINHIRELGIRPSIAISPDTEIEQIYPFLGKVDMVLMMTVNPGFAGQKFQHHVLEKIKKLQKELESHTNKPLIEVDGNIFEETVRLLEPIGADVYVVGTAALFNEKAGSYTEKLAPLREIIQER

SEQ ID NO: 13631 - protein, 492 aa, Mesembryanthemum crystallinum
MDPYKYRPSSAFNSPYFTTNSGAPVYNNNSSLTVGTRGPILLEDYHLVEKLANFDRERIPERVVHARGASAKGFFEVTHDVSHLTCADFLRAPGVQTPVIVRFSTVIHERGSPETIRDPRGFAVKFYTREGNFDMVGNNFPVFFIRDGMKFPDMVHALKPNPKSHIQENWRVLDFFSHHPESLHMFTFLFDDVGVPTDYRHMEGSGVNTYTLISKSGKVHYVKFHWKPTCGVKCLLEEEAVKIGGANHSHATQDLYDSIAAGNYPEWKLYIQTIDPADEDKFDFDPLDVTKTWPEDILPLQPVGRLVLNKNIDNFFAENEQLAFCPGIVVPGVYYSDDKLLQTRIFSYADTQRHRLGPNYLQLPVNAPKCAHHNNHYDGQMNFMHRDDEVDYFPSRYDPVRHAERYPIPPNVLNGNRDRQIIQKENNFKQPGERYRSWDPARQERFICRWVDALSDPRITHEIRNIWISYWSQADKSVGMKLASRLNVRPTM

SEQ ID NO: 13632 - protein, 167 aa, Oryza sativa (japonica cultivar-group)
GRWSATRPGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 13633 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 13634 - protein, 162 aa, Triticum aestivum
MEEGKDKNNTTEKGLFSNMMHGYPPHGGYGYPPQGYPPPGVPYPPPGAYPPPPQYGYPQPGGYPPHGGYPPVGYPGYGGGHGGHGYGGGHMGYGGGYGGGGHALGHHHGGHGYGHYGHGGHGYGHHGHGHYHGGHGWGHHGHGYHHHHHHGKQGYGKFKKCR

SEQ ID NO: 13635 - protein, 162 aa, Bidens pilosa
AQFYKYNKPRQWLTSGGLGAMGFGLPAAIGAAVARPDAVVVDIDGDGSFIMNVQELATIRVENLPVKILLLNNQHLGMVVQWEDRFYKANRAHTYLGNPSNETEIFPNMLKFAEACDIPAARVTRKADLRAAIQKMLDTPGPYLLDVIVPHQEHVLPMIPAG

SEQ ID NO: 13636 - protein, 246 aa, Triticum aestivum
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKARVDNLQRTQRNLLGEDLDSLGIKELESLEKQLDSSLKHIRTTRTQHMVDQLTELQRREQMFSEANKCLRIKLEESNQVHGQQLWEHNNNVLSYERQPEVQPPMHGGNGFFHPLDAAGEPTLHIGYPPESLSNSCMTTFMPPWLP

SEQ ID NO: 13637 - protein, 403 aa, Oryza sativa; identical to SEQ ID NO: 9267

SEQ ID NO: 13638 - protein, 802 aa, Bacillus anthracis str. Ames
MFTHVESFKSAFLEKLETMYGKSFKDSTTRDQYNTLGYMVREYMNSQWIATNESYRSGERKQMYYLSIEFLLGRLLGSNILNLGIRDVCEQGLSELGISLQQLEEVEADAGLGNGGLGRLAACFLDSLASLDLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRLHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEEVLHYYQNGGYRASDYYHHNGHIKKVVDQLTNGFFAQSGAEFEAIYDSLVIQNDEYFVLRDFGPYAERQEAVGRAYENRTKWLEMSILNIAQSGHFASDRTILQYSNEIWGIGNTVTQI

SEQ ID NO: 13639 - protein, 669 aa, Amaranthus retroflexus
MASTSSNPPFSSFTKPNKIPNLQSSIYAIPFSNSLKPTSSSSILRRPLQISSSSSQSPKPKPPSATITQSPSSLTDDKPSSFVSRFSPEEPRKGCDVLVEALEREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLSLHMLGMHGTVYANYAVDKADLLLAFGVRFDDRVTGKLEAFASRAKIVHIDIDSAEIGKNKQPHVSICGDVKVALQGLNKILESRKGKVKLDFSNWREELNEQKKKFPLSFKTFGDAIPPQYAIQVLDELTKGDAVVSTGVGQHQMWAAQFYKYRNPRQWLTSGGLGAMGFGLPAAIGAAVARPDAVVVDIDGDGSFIMNVQELATIRVENLPVKIMLLNNQHLGMVVQWEDRFYKANRAHTYLGNPSNSSEIFPDMLKFAEACDIPAARVTKVSDLRAAIQTMLDTPGPYLLDVIVPHQEHVLPMIPSGAAFKDTITEGDGRRAY

SEQ ID NO: 13640 - protein, 682 aa, Magnaporthe grisea
MLRTVGRKALRGSSKGCSRTISTLKPATATIAKPGSRTLSTPATATATAPRTKPSASFNARRDPQPLVNPRSGEADESFIGKTGGEIFHEMMLRQNVKHIFGYPGGAILPVFDAIYNSKHIDFVLPKHEQGAGHMAEGYARASGKPGVVLVTSGPGATNVITPMADALADGTPLVVFSGQVVTSDIGSDAFQEADVIGISRSCTKWNVMVKSADELPRRINEAFEIATSGRPGPVLVDPAKDVTASVLRRAIPTETSIPSISAAARAVQEAGRKQLEHSIKRVADLVNIAKKPVIYAGQGVILSEGGVELLKALADKASIPVTTTLHGLGAFDELDEKALHMLGMHGSAYANMSMQEADLIIALGGRFDDRVTGSIPKFAPAAKLAAAEGRGGIVHFEIMPKNINKVVQATEAIEGDVASNLKLLLPKIEQRSMTDRKEWFDQIKEWKEKWPLSHYERAERSGLIKPQTLIEELSNLTADRKDMTYITTGVGQHQMWTAQHFRWRHPRSMITSGGLGTMGYGLPAAIGAKVARPDALVIDIDGDASFNMTLTELSTAAQFNIGVKVIVLNNEEQGMVTQWQNLFYEDRYSHTHQRNPDFMKLADAMDVQHRRVSKPDDVGDALTWLINTDGPALLEVMTDKKVPVLPMVPGGNGLHEFITFDASKDKQRRELMRARTNGLHG

SEQ ID NO: 13641 - protein, 338 aa, Clostridium perfringens str. 13
MRYIEFDEKRKFDIVPVGRVAIDFNPTDIHKPLSESRNFNKYLGGSPANIAVGLARLGKKVGFIGKVSDDRFGEFVVNYFKKEGIDVSEISKAKNGESLGLTFTEILSPTESSILMYRNGIADLQLDVDDIDEDYIKNTKAIVISGTALAMSPSREAALKALRLAKKNGTVVIFDVDYREYNWKNKDEIAIYYSIVGKESDIIMGSREEFDLMEGLIAKDSTDEETAKRWLDYGNKIVVIKHGKDGSTAYTRDGKAYRIKPFPVKLLKSFGGGDAYASAFIYGILEGWDMMDALEFGSASAAMLVASHSCSEDMPTVEAIKEFIKKEKEEYGEMVARS

SEQ ID NO: 13642 - protein, 144 aa, Triticum aestivum
  unsure (1)..(144): unsure at all Xaa locations
RHQNVVSRPHRAKGLRYPLPLPVSLVGAPPASCSLRSPRARSMASGDSKPRSEEEWRAVLNPEQFRILRLKGTELPGTGEYNKFYGDGAYNCVGCGTPLYKSTTKFDSXGCGWPAFFEGLTGAIHRTPDPDGRRVEITCAACGG

SEQ ID NO: 13643 - protein, 419 aa, Corynebacterium glutamicum ATCC 13032
MRSVEQQLSIVTEAAVAPEPVRIAIAEALGLMCAEEVQASRALPGFAQAAIDGYAVRAVDVGGEKSLSQQLPVAPPEKSLPVVGEVAAGSQQPLRLQPKQAVMVHTGAPLPMLADAVLPMAWSDRGRKRVTAQRPVRSGEFVRKEGDDIQPGDIAVSAGAVLGPAQIGLLAAVGRSKVLVYPRPRMSVISVGAELVDIDRQPGLGQVYDVNSYSLAAAGREAGADVYRYGIAAGEPRRIKEIIESQMLRSEIIVITGAVGGAGSAGVRQVLNELGDIDTERVAMHPGSVQGFGLLGENKIPCFLLPSNPVASLVIFETFVRPVVRMSLGKSNAARRVVRARALNHVVSVAGRKGFIRSRLMRDAETQDYLVEALGGATGAPSHLLAGLSEANGMIRIPEDVTEIRPGDVVDVIFLAQGR

SEQ ID NO: 13644 - protein, 430 aa, Pyrococcus furiosus DSM 3638
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 13645 - protein, 232 aa, Glycine max
  unsure (1)..(232): unsure at all Xaa locations
PLLQLRNFGDATSESYEPASPPPRLFTKRGPTHGSALTWHMRMKCALDTSRRLVYLHEHCHPGNHAIGILKSSNILLDENFNAKLSDLGLALTDGSQSKKNIKLSGTLGYVAPEYLLDGKLSDKSDVYAFGVVLLELLLGRKPVEKLVPAQCQSIVTWAMPHLTDRSKLPSIVDPVIKNTMDPKHLYQVAAVAVLCVQPEPSYRPLIIDVXHSLIPLVPIELGGTLRVSQVI

SEQ ID NO: 13646 - protein, 336 aa, Fusobacterium nucleatum subsp. nucleatum ATCC 25586
MENKVLIINTGGTIGMVGKPLRPAYNWSEITKGYSMLEKFPTDYYQFEKLIDSSDVTTDFWINLVEVIEKNYDKYLGFVILHGTDTMAYTGSMLSFLLKNLAKPVVLTGAQAPMVNPRSDGLQNLINSIYIAGHKLFDTPLIPEVCICFRDSLLRANRSKKTDSNNYYGFSSPNYNPLAEIATEIKVISDRILKIPNEKFYVEKNIDANVLLLELFPGLNSKYISDFIESNKNIKALILKTYGSGNTPTSEDFIETLKSISKKGIPILDITQCISGSVKMPLYESTDKLSKLGIINGSDITSEAGLTKMMYLLGKNLSLQEIKNAFTSSICGEQTV

SEQ ID NO: 13647 - protein, 183 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIF

SEQ ID NO: 13648 - protein, 510 aa, Glycine max
MFIENFKVECPNVKYTETEIQSVYNYETTELVHENRNGTYQWIVKPKSVKYEFKTNIHVPKLGVMLVGWGGNNGSTLTGGVIANREGISWATKDKIQQANYFGSLTQASAIRVGSFQGEEIYAPFKSLLPMVNPDDIVFGGWDISNMNLADAMARAKVFDIDLQKQWRPYMESMLPLPGIYDPDFIAANQEERANNVIKGTKQEQVQQIIKDIKAFKEATKVDKVVVLWTANTERYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKSTIVLHNTCEDSLLAAPIILDLVLLAELSTRIEFKAENEGKFHSFHPVATILSYLTKAPLVPPGTPGVNALSKQRAMLENIMRACVGLAPENNMILEYK

SEQ ID NO: 13649 - protein, 780 aa, Nicotiana tabacum
MEDQGDIENEGGGIGVMIMENGKDLERNISAVSESGVRQPLLSSKSRVNNTSQIAIIGANVCPIESLDYEIIENDLFKQDWRSRKKVQIFQYIFLKWTLVLLIGLSVGLVGFFLNIAVENIAGFKLLLISDLMLQDKYFRGFAAYACCNLVLATCAGILCAFIAPAAAGSGIPEVKAYLNGIDAHSILAPSTLFVKIFGSALGVSAGFVVGKEGPMVHTGACIANLLGQGGSRKYHLTWKWLKYFKNDRDRRDLITCGAAAGVAAAFRAPVGGVLFALEEVASWWRSALLWRTFFSTAVVAMVLRSFIVFCRSGKCGLFGQGGLIMYDVNSGAPNYNTIDVLAVLLIGVLGGLLGSLYNYLVDKVLRTYSIINERGPAFKVLLVMTISILSSLCSYGLPWFATCTPCPVGLEDKCPTIGRSGNYKNFQCPAGHYNDLASLFMNTNDDAIRNLFSSDNSSEFHLSSLFVFFAGVYCLGVVTYGIAIPSGLFIPVILAGASYGRFVGTVLGSISNLNNGLFALLGAASFLGGTMRMTVSICVILLELTDDLLMLPLVMLVLLISKTVADCFNHGVYDQIVKMKGLPYLEAHAEPYMRQLVAGDVCSGPLITFSGVEKVGNIIHALKFTRHNGFPVIDAPPFSDAPEFCGLALRSHLLVLLKAKKFTKLSVLSGSSILRSFHAFDFAKPGSGKGPKLEDLSFTDEEMEMYVDLHPVTNTSPYTVVETMSLAKAAILFRQLGLRHLCVVPKKTTGRDPIVGILTRHDFMPEHIKGLYPHLVHHK

SEQ ID NO: 13650 - protein, 701 aa, Xanthomonas campestris pv. campestris str. ATCC 33913
MAKSPSKPAQIPSVGSSASAHELRGTGDELHQKAGGSHPQLTTNQGIPVGDNQNSLRATPRGPTLLEDFILREKITHFDHERIPERIVHARGSAAHGYFELTKSLSQYTTAKLLTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRMIEGFGIHSFRLLNENGDSTFVKFHWRPKLGLQSTIWDEAVKLAGADPDFQRRDLFEAIQKGDFPEWELGVQLFTEAEAEAFPFDHLDSTKVIPEELVPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEDGAKGRVRAESFADHYSQARMFFRSQTAPEQAHLASALVFELSKVETAHVREAIVGHLRHIDEALAKRVADGMGMTSLPPAPPAAVAPTDMQLSPALQLIGKMKDTLQGRTVGILIHDGSDAAAIKAVRKAAEAAGATVKIVAPKLGGAKLSDGKQLAADGQLAGTPSIVFDAVAVLLSSEAAKALTRESAALDFVSNAWAHLKAIAFDDGAQLLLKAGNVGKDPGVVDAADTKAFITAAKTRQWAREPKVRMLA

SEQ ID NO: 13651 - protein, 581 aa, Shewanella oneidensis MR-1
MSTSPITVVADAIIEFLAHQGIKAFHNYPGGTIAPLLDACKRFGVTVYTSRNEQGAGYAALAQGKLTQLPGIVAVTSGPGVTNVLTPVADAYFDGIPMLVFTGQVGTGDLTGQKRVRQSGFQEVDTPSLMKPITKGQFQPKNSEELYAILPIAWQLALEGRKGPVSIDLPMDVQRSAAIKSIKVPEIVTYPVNRTELGTFIDELINAIDHSQKPVIICGNGMTSPALVDAIRTLRNYWPAPVSHSLLGVGVLDTDDSGSLGFHGHTGSQLAGKAIAECDLLLVLGSRLDVRQTGTLKTAFASNAKIFRVDLDIGELTDSRIAHHKAVQAELEQFFDALHPKFAQLSPPNLSSWHNTISQWKAQLAWPYPDYPGIAPKLLLEKLSNSLPENTIVTTGVGAHQHWVARHFRFALPHRQLFTSAGHGTMGYDLPTAIGAAIHSPESTILCIAGDGSFQMNIQELGVIKELGLKIKILVLDNHRLGLVSQFQLMNWETDTACGNKQSPNFALIAQGYGIKALHCSDSAKLEQTLAEFIETDESILLHIEIATQHDVLPMLLGGQTTDKMWPYFDMQGNPRDPSNV

SEQ ID NO: 13652 - protein, 76 aa, Glycine max
MSGLIEGLPDAVAIRCLAWVPFYLHPKLELVSRAWRAVVRGPELFKARQELGSSEDLLCVCAFEPENLWQLYDPQR

SEQ ID NO: 13653 - protein, 285 aa, Arabidopsis thaliana
MAAVSSSSETGDCGVTGKRDEIMLFGVRVVVDPMRKCVSLNNLSDYEKSSPEDEIPKIVTAGAGDGEDKNETDATVIVADGYASANDAVQISSSSVGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVPTKTENAPETFHLNDPYLVPVTFQAKPTFNLNTDAAPLSLNLCLASSFNLNEQPNSRHSAFTMMPSFSDGDSNSSIIRVA

SEQ ID NO: 13654 - protein, 523 aa, Perilla frutescens
MISAAVSLIICTSILGVLVYFLFLRRGGGSNGRPLPPGPRPWPIVGNLPQLGPKPHQSMAALARVHGPLMHLKMGFVHVVVAASATVAEKFLKVHDTNFLSRPPNSGAEHIAYNYNDLVFAPHGPRWRLLRKICALHLFSSKALDDFRHVREEEVGILIRNLASVGEMPASIGQMMYVCATNAISRVMLGRHVLGDEHRGAAGGGDTTAEEFKAMVVELMALAGVFNVGDFIPPLKGLDLQGVVAKMKKLHQRFDAFFSGILHDHKINGSNAAEGHVDLLTTLISLKDVDNNGEGGKLTDTEIKALLLNLFTAGTDTTSSTVEWAITELIRNPNILARVRKELDLIVGKDKLVKESDLGQLTYLQAVIKENFRLHPSTPLSLPRVAQESCEINGYYIPKDSTLLVNVWAIGRDPNVWPDPLEFRPERFLMGGEKPNVDVRGNDFELIPFGSGRRICAGMNLGIRMVQLLIATMVHAFDFELANGQLAKDLNMEEAYGITLQRADPLVVHPRPRLARHVYQAQV

SEQ ID NO: 13655 - protein, 451 aa, Neisseria gonorrhoeae
RFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 13656 - protein, 404 aa, Triticum aestivum
MAFCSPHSTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIGPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 13657 - protein, 358 aa, Zea mays
  unsure (1)..(358): unsure at all Xaa locations
MTLSKKQGAGTDQQALLDAQLQLWHHTIAFVKSMALKAAVDLRIADAIHLHGGSATLSQIVTKVTLHPSKIPCLRRLMRVLTLTGVFSVNTGAVVDEPVYGLTPASRLLVGPGLNQTPFLTLMLSTFFVSSFLGLDEWFQHETGPSPFELANGRDIWTLSGHDXSFGKLFDDGMVADSGFIMDVVVKECGDVFRGVGSLVDVAGGLGGATQTIAKAFPDVACSVLDLPHVVANAPTDTTVKYIAGDMFESIPSANVVFLKWILHDWGDAECVKILKNCKKAIASQEEGKVVILDMVVGAGSSDEKHVETQIVFDLFMMFINGTERDETEWKKIIFEAGFSRYKIIPVLGVRSIIEVYP

SEQ ID NO: 13658 - protein, 125 aa, Glycine max
  unsure (1)..(125): unsure at all Xaa locations
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 13659 - protein, 413 aa, Oryza sativa (japonica cultivar-group); identical to SEQ ID NO: 5417

SEQ ID NO: 13660 - protein, 534 aa, Pseudomonas fluorescens PfO-1
MKLLAVRRLLRIQRVVIRYRLDDLLFDLPLPWFLLALRYVLPWRWFPRKPLELSRGARLRLALQDLGPIFIKFGQILSTRRDLLPEDIADELMRLQDRVPPFDSQLSVKLIEEQLGKKISEVFSRFDVEPLASASVAQVHAAQLKTGEEVVVKVIRPGLKPIIAQDLAWLFILARAAEKVSADARLLHPVDVVSDYEKTIYDELDLLREAANASQLKRNFEGSPLLYVPQVYWDWCRPKVLVMERIYGIQVTDLATLADQRTDMKMLAERGVEIFFTQVFRDSFFHADMHPGNIFVSTVNPWSPQYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPDLDLWNTAQPFLERWMRERVSPKALLGNVQSQFEQLPHLANMARDLLERMSQPHANDPPPPWKKRKDDWFLRLLGSAHLAGGTILAAGGPLHELGHWPAGIMVAVGLYLVVRR

SEQ ID NO: 13661 - protein, 355 aa, Sporothrix schenckii
MGACMSSNSEEVEQKKRSQKIDKDLEEDSKRLRRECKILLLGSGESGKSTIVKQMKIIHLKGYSEDELFSYRPTVFKNLLECAKAVINAMRQFEIELESDEIRAYCDFLLDYSIGSGPQPSIDPKVGEAVLALWEDPVRGQLMERQTEFYLMDSAGYFFDEVRRIVHPDYIPNEMDVLRARTKTTGIYETRFQMGPLSIHMFDVGGQRSERKKWIHCFEDVTSIIFCVALSEYDQVLLEESSQNRMMESLLLFDSVVNSRWFMRTSIILFLNKVDIFKQKLGRSPLGNYFPDYSGGDDANKAAKYLLWRFNQVNRAHLNLYPHLTQATDTSNIRLVFAAVKETILNNALKDSGIL

SEQ ID NO: 13662 - protein, 501 aa, Arabidopsis thaliana
MAIPMPTRQLFIDGEWREPILKKRIPIVNPATEEVIGDIPAATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAPWGGVKRSGFGRELGEWGLDNYLSVKQVTLYTSNDPWGWYKSPN

SEQ ID NO: 13663 - protein, 313 aa, Bradyrhizobium japonicum USDA 110
MSLAPSIPVPRSRFNTLPLAIGLFCLLWSYAFVAGKIGVTHCPPLILLAARFSLAGILILGATLIRGDSWSLSWRDAAIFAVLGIANNALYLGLGYTGLQSVSAGLGGLIVSANPVFTAALAALLLGEGMTWRKAGGLLLGVIGVTAIVWHRLSVGTDSWHGIVFTLASLASIVLGTILFKLLAPKGSLWIGNGVQNLAAGIVLTPVALTFADVHAIDVTPSLIGAFAFLVLGGSILAYWLWFHLLKVCGATAASAYHFLMPPLGMLFAFLVLGEHVEARDLLGIIPVALGIYLVTRPAKSLSSKLLPSKAAS

SEQ ID NO: 13664 - protein, 356 aa, Aspergillus fumigatus
MGSCFSTESPGDAEQKKRSQAIDRRLEEDSRRLRRECKILLLGSGESGKSTIVKQMKIIHQNGYTVEELALYRLTIYKNLLDCAKALIGAYHQFNLQPTSPKVREFIEFLSEYNIDPDPNTPLDPRIGDAVTYLWNDPCTSTALEHQNEFYLMDSAPYFFEEAKRIAAPDYIPNVADVLRARTKTTGIYETRFTMGQLSIHMFDVGGQRSERKKWIHCFENVTSIIFCVALSEYDQVLLEESNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 13665 - protein, 430 aa, Oryza sativa
  unsure (1)..(430): unsure at all Xaa locations
MATGKSGGSSAEDLGHHAGYYRLPNTHDARLFYFFFESRGSKGEDDPVVIWLTGGPGCSSELALFYENGPFHIADNMSLVWNDFGWDQESNLIYVDQPTGTGFSYSSNPRDTRHDEAGVSNDLYAFLQAFFTEHPNFAKNDFYITGESYAGHYIPAFASRVYKGNKNSEGIHINLKGFXAIGNGLTDPAIPYKAYTDYSLDMGLITKSQFNRINKIVPTCELAIKLCGTSGTISCLGAYVVCNLICSSIETIIGKKNYYDIRKPCVGSLCYDLSNMEKFLQLKSVRESLGVGDIQFVSCSPTVYQAMLLDWMRNLEVGIPELLENDIKVLIYAGEYDLICNWLGNSRWVNSMEWSGKEAFVSSSEEPFTVDGKEAGILKSYGPLSFLKVHDAGHMVPMDQPKVALEMLMRWTSGNLSNASSSFQRLDFTM

SEQ ID NO: 13666 - protein, 302 aa, Ipomoea batatas
MDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 13667 - protein, 433 aa, Bacillus anthracis str. Ames
MRVGKIHTRKLFICFCLAVVLFVPIHTFADEKREWRDEVIYSIMIDRFNNGEPKNDKQLEVGNLEGYQGGDIRGIIKRLDYIKEIGFTTVMLSPLFESVKYDGVDVRNFQKVNEHFGTENDVKELVQEAHTKGMKVILQFPLGENEQQVIDSMKWWVKEVDLDASYVMHSEKKSPAFWDDVQKDMQVIKKDFRVMTKEDSEYNEKIVESFSKADVSVKSLYDVSKKDEEFITFLDNQDTKRFARIAKENMNYPPSRLKLALTYLLTSPGIPNFYYGTEIALDGGDTPDNRRLMDFKSDEKFMQHITKLGELRQMRPSLRRGTFELLYDKNGMSVLKRKYKGEVTLVAINNTKETQKVALPASTIGEKQELRGLLEDEIIREENGKFYLVLKREESNVYKVNRETGVNWLFISLIVGVNVLFITFLIAVKKRRK

SEQ ID NO: 13668 - protein, 340 aa, Paracoccidioides brasiliensis
MFAARRAFGFAQRRAFSVSAPQSSKVAILGAAGGIGQSLSLLMKLSPRVTQLALYDIRGGPGVAADLSHINTNSTVTGYDPTPSGLRDALKDSEIVLIPAGVPRKPGMTRDDLFNTNASIVRDLAKAAADASPNANILVIANPVNSTVPIVAEVFKSKNVYNPKRLFGVTTLDVIRASRFISQVKGTDPKDEKVTVVGGHSGVTIVPLISQSNHPDISGEKLETLVNRIQFGGDEVVKAKDGAGSATLSMAMAGARFAESLLKASQGEKGVIEPTFVDSPLYKDQGIDFFASRVELGPNGVEKILPVGKVSEYEQKLLDACLVDLKKNIAKGVEFVKTNP

SEQ ID NO: 13669 - protein, 221 aa, Escherichia sp. Souza-207
DLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYQ

SEQ ID NO: 13670 - protein, 593 aa, Klebsiella pneumoniae
MAKMRAVDAAMYVLEKEGVNTAFGVPGAAINPFYSAMRKHGGIRHILARHVEGASHMAEGYSRATAGNIGVCLGTSGPAGTDMITALYSASADSIPILCITGQAPRARLHKEDFQAVDIESIAKPVTKMAVTVREAALVPGVLQQAFHLMRSGRPGPVLIDLPYDVQVAEIEFDPELYSPLPAYKPIATRPQIEKALALLVQAERPVIVAGGGVINADAAALLQQFAEITHVPVIPTLMGWGCIPDDHELMAGMVGLQTAHRYGNATLLASDLVFGIGNRFANRHTGSVEKYTAGRKIIHIDIEPTQIGRVLCPDLGIVSDAKAALIQLVDIAQQMQKEGRLPRRESWVSECQARKRTLLRKTHFDNVPVKPQRVYEEMNKAFGRDVCYVTTIGLSQIAAAQMLHVFKDRHWINCGQAGPLGWTLPAALGVCAADPERNVVAISGDFDFQFLIEELAVGAQFNIPYIHVLVNNAYLGLIRQSQRAFDMDYCVQLAFENINSSEVNGYGVDHVKVAEGLGCKAIRVFKPEDIAPAFEQAKAWMKAYRVPVVVEVILERVTNISMGSELDNVMEFEDVADSAIDAPTETCFMKYE

SEQ ID NO: 13671 - protein, 467 aa, Gelidium pulchellum
  unsure (1)..(467): unsure at all Xaa locations
PYAXMGYWDPDYAVKETDVLALFRVTPQPGVDPVEASAAVAGESSTATWTVVWTDLLTACDLYRAKAYKVEEVPNSSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHXHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIXXXXGRSFVEEGPQILRDAAKTCGPLQTALDLWKDISFNYXSTDTADFVETPTANV

SEQ ID NO: 13672 - protein, 852 aa, Oryza sativa
MRRHPLLPLLAAVLVGAAVRAGKIATEVVVPDFVASYLLFIDTYGVFLQSGGGGAFQAVVYNPAGQQDRYYLAVVHAPSKTCVWVANRDAPITDRAAPLRLTARGISAEDPNGTVRLPVGGFLASAVSDSDYTVGGYRLDVTAADAALTWNGSLYWLLSIDVKSTRDRDGAVASMAVNGTGLYLLAADDTVLIQLPLPDAKLRIVKLGVEGKLVITSYASANATSPSPTDAGFVAPNSGCDLPLSCGALGFCAPNGNASSCTCPPLFASSHDGGCTPADGSKAMTVASCGGAGGDAAPTSYISLGNGVAYYANRFSRPDMVGSNGSSCQALCSGNCSCLGYFYDESSLSCFLVQHQIGSLVNANSRRGDMVGFIKVQSSQSPGSPSGSSSNNSTLIAILLPTIVAFVLVVVVGAVIVVSWRKQERRAGRRASRSRDVQLRRHRSPASDSAHLVYGNDDDGNDIVIPGLPTRFTHEEIEDMTNSFRIKIGAGGFGAVYKGELPDSSAVAVKKIEGVGMQGKREFCTEIAVIGNIRHVNLVRLRGFCVEGQRRLLVYEYMNRGSLDRTLFRPAAGQPLEWKERMEVAIGAARGLAYLHFGCDQRIIHCDVKPENILLADGGQVKIADFGLAKLLTPEQSGLFTTMRGTRGYLAPEWLTNTAITDRTDVYSFGMVLLELVRGRKNRSEHVSDGAGAATGDDSNSSNGTTGSSSRGARSDYFPLMALEGHEAGQYAALADPRLEGKVVAGEVERVVKVGLCCLHEDPQLRPSMAMVAGMLEGTMELWEPRVQSLGFLRLYGRGFAGPADGSGGSGGGIKQAMAGSNGDHTRSGTTTVTTMSGWPSYMSSSQLSGPR

SEQ ID NO: 13673 - protein, 311 aa, Haemophilus influenzae Rd
MKVAVLGAAGGIGQALALLLKLQLPAGTDLSLYDIAPVTPGVAVDVSHIPTAVNVKGFSGEDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWNEDEIEPLTKRIQNAGTEVLNAKAGGGSATLSMAQAAARFARSLVKGLSGETVVECTYVEGDGKYARFFSQPVRLGKEGVEEILPIGPLSNFEQQALENMLPTLRADIELGEKFING

SEQ ID NO: 13674 - protein, 575 aa, Archaeoglobus fulgidus DSM 4304
MAQISGGELLVRCLIKENVRYIFGVPGGQLLTFLDAIKRVGEKHGMKFVNCRHEQAAASMADAYARVSGEIGVCVGTIGPGGADLVPGVYPAFADSVPMLVITAQNQTWKSYPDHGSMQALDQYHLFKPITKWNAVVSHWERIPELVQRAIRIALSGRPGPVHLDFPSDVLYNGQEESFAKVYGPERYRPMKPPVGHPELVEKAAEMLYNAERPLIHAGTGVLRAKAWNELRELAEYLGAVVTTTMGGRGAIPEDHPLCILPASPAAITAQNEADVILVVGSKMGDLDFWGKPPAWGDPEQQKTIQIDIDPEMIALNRPVDVAIVGDAKETLKALIEAVKKKGEKREPVDRLKEYRKMQQDWLEGFLKLAESGEKPIHPLRVIKEVREFYPRNAISCVDGGNTAVWASYLNRIYEPNTFLWAADSGHLGTGLPYAIGAKLANPDRPVYLIAGDGAFGLTMEELETASREGVKITAVVMNDGCWGMIKGSQKAAFGGRFIGVDFKDVRYDKVAESMGWYGQRVEEPEDIATALDKAESSDKPALLDVKISQEANLSPPDLITLSIVWLEGCNPPPV

SEQ ID NO: 13675 - protein, 186 aa, Xanthomonas campestris pv. campestris str. ATCC 33913
MNDCSRCAGSTSSGPAHWSGRIRDIADFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEIVGAAVLVELLALQGRSKWLNDVPLLATLSY

SEQ ID NO: 13676 - protein, 503 aa, Glycine max
  unsure (1)..(503): unsure at all Xaa locations
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCXEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 13677 - protein, 159 aa, Ralstonia eutropha
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 13678 - protein, 300 aa, Oryza sativa
MRPSLMRSASQVLRRRRGYSSASGQPERKVAILGAAGGIGQPLSLLMKLNPLVSSLSLYDIAGTPGVAADVSHINAPAQVKGFMGDDQLGEALEGSDIALVNMISNPVNSTVPIAAEVFKKAGTYDEKKLFGVTTLDVVRAKTFYAGKANVPVTDVNVPVVGGHAGITILPLFSQATPATNALSDEDIKALTKRTQDGGTEVVEAKAGKGSATLSMAYAGAVFANACLKGLNGVPDVVECSFVQSTVTELPFFASKVKLGKNGVEEVLGLGQLSDFEKEGLENLKGELKASIEKVLAPDL

SEQ ID NO: 13679 - protein, 446 aa, Mycobacterium tuberculosis H37Rv
MDRQKEFVLRTLEERDIRFVRLWFTDVLGFLKSVAIAPAELEGAFEEGIGFDGSSIEGFARVSESDTVAHPDPSTFQVLPWATSSGHHHSARMFCDITMPDGSPSWADPRHVLRRQLTKAGELGFSCYVHPEIEFFLLKPGPEDGSVPVPVDNAGYFDQAVHDSALNFRRHAIDALEFMGISVEFSHHEGAPGQQEIDLRFADALSMADNVMTFRYVIKEVALEEGARASFMPKPFGQHPGSAMHTHMSLFEGDVNAFHSADDPLQLSEVGKSFIAGILEHACEISAVTNQWVNSYKRLVQGGEAPTAASWGAANRSALVRVPMYTPHKTSSRRVEVRSPDSACNPYLTFAVLLAAGLRGVEKGYVLGPQAEDNVWDLTPEERRAMGYRELPSSLDSALRAMEASELVAEALGEHVFDFFLRNKRTEWANYRSHVTPYELRTYLSL

SEQ ID NO: 13680 - protein, 170 aa, Enterococcus faecalis V583
MDLRDYIASIPDYPEKGIVFRDISPLMANGDAYREATKQIVDYAKEKRIDMVVGPEARGFIVGCPVAYELGVGFAPVRKKGKLPRETIEVTYDLEYGSDTLTLHKDAITPGQRVLICDDLLATGGTIKATIELVEQLGGIVVGCAFLIELMDLHGRDKIDGYDIVTLMEY

SEQ ID NO: 13681 - protein, 648 aa, Neurospora crassa
MWSPFNTRNGNGASPSLSRLLTLSTLAALAPLSEAQFPPYQAVGLKTVTSPSNPNIKISYKEPKDVCTTAFRRQKQYTGWVTVPGEYPTHLFFWFVGAREPTSALTMMLNGGPGSSSMFGLFAENGPCQVVEKGASRLETAAREWGWDRASNMLFVDQPNHVGFSYDTPTNGSLDLTTGMVSPTMQLPDNLPPSLFLNGTFSSNNIQNTANTTQNAAMAVYHLLQGFLSTFPEYVPDKHSPLGVNLFTESYGGHYGPVFADTWQKENDKLSKRAMPLSRRQDDANNIQSRPPKAGSSNREIKLTSLGIMNGCIDDLVQGSRYVEMAINNTYGIKLIDQATADAITSGFNAPDTGCKDLILACRQAQAALDPLDQGTDETVNQVCAYASLTCQQLLGSVLASGANAYDIAHMGPDAFPDYHYLEYLNSRRVQEAIGSVVNYTDISPVVYQAFFQTGDRARGGLIAKLASLLQRGVRIGLVYGDRDYICNWMGGEAVSLALADAMEDLDPKSPYPTKFPQAGYENIQTNNREVGGVVRQFGNLSFSRIYQSGHFVPAYQPETAFRVFERIIGGRSVATGARVNLRDFATRGPKKADKQLKAPKDVSAKCFLRNLGSTCTQEQVMAILMGEGVVINGVWYKEKKDWSPVTV

SEQ ID NO: 13682 - protein, 335 aa, Methanopyrus kandleri AV19
MNASPTVVVIPGDGIGPEVIDAALKVVRAVLGDELEIVEEQAGYSLWKKRGVTIEDETIERCREADAMLFGACTTPEDPEAKSPIVTLRKELGLYANVRPARSWPVPRPVDTEFDLVIVRENTEGLYTGCECEIHDGVTVALRKISEEGTRRVAEVACDLAEERSGRVTIVHKANVLKLTCGTFKRVAAETVERRGLEWDDEYVDAAAYKLVREPDSFDVILTSNLFGDILSDLAAGLMGSLGLAPSANLGDDAALFEPVHGSAPDIAGKGIANPVAAILSAAMMLDHLGYGEEARIIERAVEEVLREGVRTPDLGGSATTEEVAEAIAERVATG

SEQ ID NO: 13683 - protein, 492 aa, Capsicum annuum
MDPYKHRPSSAANSPYWTTNSGAPVYNNNSSLTVGARGPILLEDYHLLEKLANFDRERIPERVVHARGASAKGFFEVTHDITRLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGSGVNTYTLINKAGKAHYVKFHWKPTCGVKCLLDDEAVKVGGTNHSHATQDLYDSIAAGNYPKWKLFIQTIDPDHEDKFDFDPLDVTKIWPEDILPLQPVGRLVLNKNIDNFFVENEQLAFCPAIIVPGIHYSDDKLLQTRVFSYADTQRHRLGPNYLQLPPNAPKCAHHNNHHEGFMNFMHRDEEVNYFPSRFDPCRHAEQYPIPPRVLNGKRDRCIIQKENNFKQPGERYRSWAPDRQERFICRWVDALSEPRVTHEIRTIWLSYWSQADKSLGQKLASRLNVKPTM

SEQ ID NO: 13684 - protein, 355 aa, Bifidobacterium longum DJO10A
MTIATPERYAEMLEAARRGGYAYPAINVTSSQTLNAALKGFADAESDGIIQISVGGAAYVSGRGVNDRVTGSLALAAFAHEVAAKYPNITIALHTDHCAKQYLDEWVRPLLAHEADQVARGQEPTFQSHMWDGSTVPLKENLDIAEELLDKSQKAHTVLEIEIGAVGGEEDGHSAEINEKLYSTPEDGLEVARRLGLGERGRYMAAFTFGNVHGAYKPGVVKLRPSLLGDIQARVARAVAEGELPSAAGIVDFPNGKPFELVFHGGSGSRPEEIAEAVSYGVIKMNIDTDTQYAFTRPIADHVFENYDKVLKIDGEVGEKKFYDPRSWGRKAEDSMSARVVEACRQLGSAGKALK

SEQ ID NO: 13685 - protein, 364 aa, Lactobacillus plantarum
MKRYLVLEDGTIYPGTGFGATTATVGELVFNTGMSGYQESITDQSYNGEILMFTYPLIGNYGINRDDHESIKPTCKGVVVHEVARRASNWRNAQSLDDYLKQNAIPGIMDIDTRAVTKHIRTKGAMKATIVDNVLPDTVDRLKITELNRAVVAQSSTNNAYPNPATGPNVVVVDFGLKHSILRELAKRQCNLTVLPYNTTASEIMALNPDGVMLTNGPGDPKDVPGALEMIREVEKHVPLFGICLGHQLFALANGADTFKMKFGHRGFNHPVREIATGRIDFTSQNHGYAVDRDSLAQTDLLITHEEINDGTVEGLRHRDYAAFSVQYHPDAAPGPHDADHIFDEFIDLMAANQATQKGSQFNA

SEQ ID NO: 13686 - protein, 412 aa, Ralstonia eutropha
MTQAAAPSRPPMLTMAQALDALLGAARPLAQLESIDTLHANGRVLAAPVTSTLRVPPADNTSMDGYAMRAGDVPAAGTRLRVSQRIPAGHVGTALEPGTAARIFTGGLIPPGADAVVMQEQCTAEGEDVIVNHVPQSGEWVRRAGEDIEAGSVILPAGTRLTPQALGLAASVGQAKLDVVRRVRVAVFFTGDELAMPGEPLKPGAIYNSNRFTLRGLLENLGCEVSDFGIVPDTLAATRETLRRAAQGHDLIITSGGVSVGEEDHIKPAVEAEGRLDMWQIAIKPGKPLAFGQVNNDAGPAFFLGLPGNPVSSFVTFLLFVRPFILRLQGVAGVTPRRLPLRADFELNKGDRRNEFLRARINAEGGLDLFPNQSSGVLTSTVWGDGLIDNPPNQPIARGDTVQFIPFDGLLA

SEQ ID NO: 13687 - protein, 654 aa, Methylococcus capsulatus
  unsure (1)..(654): unsure at all Xaa locations
MLREATAISNLEPPLTASYVESPLDAAIRQAKDRLLSLQHLEGYWVFELEADCTIPAEYILMMHFMDEIDAALQAKIANYLRHHQSADGSYPLFRGGAGDISCTVKVYYALKLAGDSIDAPHMKKAREWILAQGGAARSNVFTRIMLAMFEQIPWRGIPFTPVEIMLLPKWFPFHLDKVSYWSRTVMVPLFILCSHKVTARNPSRIHVRELFTVEPQKERHYFDHVKTPLGKAILALERFGRMLEPLIPKAVRKKATQKAFDWFTARLNGVDGLGAIFPAMVNAYEALDFLGVPPDDERRRLARESIDRLLVFQGDSVYCQPCVSPIWDTALTSLTLQEVARHTADLRLDAALSKGLKWLASKQIDKDAPGDWRVNRAGLEGGGWAFQFGNDYYPDVDDSAVVAHALLGSEDPSFDDNLRRAANWIAGMQSRNGGFGAFDADNTYYYLNSIPFADHGALLDPPTADVSARCAMFLARWVNRQPELRPVLERTIDYLRREQEADGSWFGRWGTNYIYGPGAVLLAYEGRRVPNDDPSVRRAVAWLKSIQREDGGWGEDNFSYHDPSYRGRFHTSTAFQTGFALIALMAAGEXGSPEVQAGVDYLLRQQRPDGFWNDECFTAPGFPRVFYLKYHGYDKFFPLWALARYRNERYALA

SEQ ID NO: 13688 - protein, 572 aa, Xanthomonas axonopodis pv. citri str. 306
MALSQNDPHRAPAASPADHAVVGGMSRRTQILRLLLRYRGSGVFAGMNLDPAAINEYEVPAEGTPDQFVSDLESLGPTFVKLGQMLSTRPDIVPPEFATALERMQENTSSVPVERIRQIIEEELGVSVNKAFSFFDPVPLGCASLAQVHRAALRDGTPVAIKVQKPEVAAQVRSDLDVLKSFATAADRLTGIGRRVRFADWLGEFGKTLRAELNYEDEAETLARFGKHLKPFPLLWVPQPVWDLSSRKVLTMQLAEGVRVDKISGLRRTEQPMDELAAELVKGYLDQMFVHGEIHADPHPGNLRVLQDGRLAIFDLGMVAHVPPRLRERLLKLLFAAVDGRGEEVAEETIALSTRLEDYDEERYQRETGQMIARYAAHDATSEGRVVLDLVRIATSTGLRTPPELSLLGKTLLNLEGVCRALSPTLDTRRIVERHLQHVMRARLKKSLSAANLASEAMELQHLVREGPRRMSEILSLAAENRLQMRVTGLEESHLMESLQKIANRVAAGIVTAALIMASAQMMRIETGLKLWGYPAIAMVLFLLGVVLGLGIVVSALLFDRRVRAREERGHR

SEQ ID NO: 13689 - protein, 335 aa, Xanthobacter flavus
MSVKVAINGFGRIGRNVLRAIIESGRTDIEVVAINDLGPVETNAHLFRFDSVHGRFPGEVKVAGDTIDVGRGPIKVTAVRNPAELPHKELGVDIALECTGIFTSRDKAAAHLAAGAKRVLVSAPADGADLTVVYGVNHEKLTNEHLVVSNASCTTNCLAPVAKVLNDAVGIEKGFMTTIHAYTGDQPTLDTMHKDLYRARAAAMSMIPTSTGAAKAVGLVLPELAGKLDGTSIRVPTPNVSVIDLKFVAKRATSKEEINEAIIAAASQQLKGILGFTDQPNVSIDFNHNPNSSTFHLDQTKVMEGTLVRVLSWYDNEWGFSNRMSDTAVAMGKLG

SEQ ID NO: 13690 - protein, 98 aa, Glycine max
  unsure (1)..(98): unsure at all Xaa locations
KACNAFFLKVNPIGFLXKVFNXVRMSKKTGWGVLASPQNGETEDPFLAALFFGLAPGQIKTGAPSRSKGFFKYNQLFKIXEELGSEPVFFGANFRTPV

SEQ ID NO: 13691 - protein, 535 aa, Arabidopsis thaliana
MAGDQLNVLNALDVAKTQWYHFTAIIIAGMGFFTDAYDLFCISLVTKLLGRIYYHVDGSEKPGTLPPNVSAAVNGVAFCGTLAGQLFFGWLGDKLGRKKVYGMTLMVMVLCSIASGLSFGSNPKTVMTTLCFFRFWLGFGIGGDYPLSATIMSEYANKKTRGAFIAAVFAMQGFGILTGGIFAIIVSAAFEAKFPAPTYQIDALASTVPQADYVWRIILMVGALPAAMTYYSRSKMPETARYTALVAKDAKLAASNMSKVLQVEIEAEQQGTEDKSNSFGLFSKEFMKRHGLHLLGTTSTWFLLDIAFYSQNLFQKDIFSAIGWIPPAQTMNAIQEVFKIARAQTLIALCSTVPGYWFTVAFIDVIGRFAIQMMGFFFMTVFMFALAIPYDHWTHKENRIGFVAMYSLTFFFANFGPNATTFVVPAEIFPARFRSTCHGISAASGKLGAMVGAFGFLYLAQSPDKTKTEHGYPPGIGVKNSLIVLGVVNLLGMVFTLLVPESKGKSLEEMSGENEQNDESSSSSNNNSNNAVSTA

SEQ ID NO: 13692 - protein, 479 aa, Vibrio parahaemolyticus RIMD 2210633
MTNKKLTTAAGCPVAHNQNVMTAGPRGPQLLQDVWFLEKLAHFDREVIPERRMHAKGSGAYGTFTVTHDITKYTRAKIFSEVGKKTELFARFTTVAGERGAADAERDIRGFALKFYTEEGNWDLVGNNTPVFFLRDPLKFPDLNHAVKRDPRTNMRSSTNNWDFWTSLPEAFHQVTIVMSDRGIPASYRHMHGFGSHTFSFINAENERYWVKFHFKTQQGIKNIGDEEAQLLAGKDRESHHRDLYESIERQDFPKWKMYVQIMPELEADEVNFNPFDLTRVWSQKDYPLIPVGEFELNRNPENFYAEVEQSAFNPAAIVPGIGFSPDKMLQGRLFAYGDAQRYRLGVNHHQIPVNAPRCPVHSYHRDGAMRVDGNFGSTLGYEPNYKQEWAEQPDYSEPPLRISGHADHYDHRVDEDYFSQAGDLFRLMNEEQRQALFDNTARAMDGVPDFIKERHVTHAYQADEAYGKGLELALGLAK

SEQ ID NO: 13693 - protein, 227 aa, Tsuga mertensiana
NTGLEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAADSLDYILDTIPVAHP

SEQ ID NO: 13694 - protein, 460 aa, Botrydium stoloniferum
SDRYESGVIPYAKMGYWDADYNVKSTDVLALFRITPQPGVDPVEAAAAVAGESSTATWTVVWTDLLTACDLYRAKAYRVDPVPGTTDQFFAYIAYQCELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGINRAAAATGEVKGSYLNVTAGTMEDMYERAEYAKQIGTIIVMIDLVIGYTAIQSMAIWARKNDMILHLHRAGNSTYARQKNHGINFRVICKWMRMSGVDHIHAGTVVGKLEGDPLMVKGFYNTLLNTTLEINLSQGIFFDMDWACLRKTVPVASGGIHCGQMHQLLYYLGDDVVLQFGGGTIGHPDGIQAGATANRVALEAMVLARNEGRDYLNEGPQILRDAAKMCGPLKTALDLWKDITFDY

SEQ ID NO: 13695 - protein, 545 aa, Candidatus Blochmannia floridanus
MIFKNINRFCYIIRIILLYGLSDCIPTNRLIFPLNIGNQFLLKFFNKHSHLSLGERFRLALQELGPIWIKFGQMLSTRRDILSNSITNQLVMLQDQVKPFDGALAKLYIEQSIGNPLEKWFEDFQEIPLASASISQVHSAKLKKNGQNIIIKIIRPGIIPIIKTDINLMYKLSKWAYKLFPKRQQFKFSKIVLEYKKILFNELNLLKETANTIKLKRNFKSSNILYIPEVYVDFCRENIMVMERIYGIPIYETEKLKKQGIDMKLLAERGVEIFFTQVFRDSFFHGDMHPGNIFINYKNPQNPQYISIDCGIMGSLNKKDKYYLASNFIAFFNRDYRKIAELHLDSGWIPIDTNIEDFEYEIRTVFEPIFEKPLIDIPFSSVLLHLFNIARYFQMEIQPQLILLQKTLLYIEGIVRQLYPHLNLWQSAKPFLENWMQEQLQFSKIIHILKDKIPCWINKFPELPLLLSNELKYSFEIKKNINILTQELRIQRTRNAQALFLFGIGLILIISSIFCFMQFKKIETLPIYLCIFGIFIWIIGWKRIS

SEQ ID NO: 13696 - protein, 308 aa, Oryza sativa
MEVNGGGAAGLPEAWSQARAPVIVPLLRLAVAVCLTMSVLLFLERMYMAVVISGVKILRRRPDRRYRCDPIPDDDPELGTSAFPVVLIQIPMFNEREVYQLSIGAVCGLSWPSDRLVVQVLDDSTDPVIKEMVRIECERWAHKGVNITYQIRENRKGYKAGALKEGMKHGYVRECEYVAIFDADFQPDPDFLRRTIPFLVHNSDIALVQARWRFVNADECLMTRMQEMSLDYHFTVEQEVSSSVCAFFGFNGTAGVWRVSAVNEAGGWKDRTTVEDMDLAIRASLTGWKFVYLGDVRSKVSRQAFKAF

SEQ ID NO: 13697 - protein, 544 aa, Oryza sativa (japonica cultivar-group); identical to SEQ ID NO: 9835

SEQ ID NO: 13698 - protein, 538 aa, Lycopersicon esculentum
MANDLQVLNALDVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAISEAKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGHWCEELVDRPWLCNFLGMLFTFLVPESNGKSLEDLSRENEGEEETVAEIRATSGRTVPV

SEQ ID NO: 13699 - protein, 124 aa, Zea mays; identical to SEQ ID NO: 938

SEQ ID NO: 13700 - protein, 465 aa, Staphylococcus xylosus
ENSMTAGPRGPLLMQDIYFLEQMAHFDREVIPERRMHAKGSGAFGTFTVTNDITKYTCASIFAEIGKQTEMFARFSTVAGERGAGDAERDIRGFALKFYTEEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYTAEEAEQVIAKDRDSSQRDLFNTIEQGNFPKWKMYIQVMTEEQARNHKDNPFDLTKVWYKDEYPLIEVGEFELNRNPENYFQDVEQRAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSYEEQQTLFKNTANEMSPVTDALKHRHIRHCYKADPAYGQGVAEAMG

SEQ ID NO: 13701 - protein, 54 aa, Glycine max
GYARLFIAQCFAKGFADRLQVFSTDFIDEDFVDACAGLTHARVEGKASMPEFNY

SEQ ID NO: 13702 - protein, 451 aa, Glycine max
  unsure (1)..(451): unsure at all Xaa locations
IIGYLRRIGVFSEYGMRLLFLRCREAWLTGILEDLDQANPYEYLKGMINCHRMHLFISDPXNLNRVNLLEANPVPXDESVMLDAALAIINKEQSLRMSLLGASPDLSFAXFAENRTMESATASSSESETALPLPLASESQQPYVSTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESKSVAENGESPKMENGETPDAKESEAVNSEEVNEEGTEEGPTLQTDREDTNLEKPLE

SEQ ID NO: 13703 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 13704 - protein, 366 aa, Oryza sativa
MARRSAPLLQRLLSPTPSPSPSPPHPLAAAAVSRRTVTYMPRPGDGAPRAVTLIPGDGIGPLVTGAVRQCYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 13705 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVAGMGIAPGANIGDECALFEATHGTAPKYAGQDKVNPGSIILSAEMMLRHMGWTEAADLIVKGMEGAINAKTVTYDFERLMEGAKLL

SEQ ID NO: 13706 - protein, 121 aa, Oryza sativa
  unsure (1)..(121): unsure at all Xaa locations
QYWRVLDFLYHHPESLHTFLFLXDDLCIPTDHRHMDGVXVNTYTFVSXDTHKAWFVKFHWXPTCGVCWFADDQATRRKGMIHTHRTKXLCCSMCHGNFRECELLLQVINPEEEEWFDFYRV

SEQ ID NO: 13707 - protein, 319 aa, Fagus sylvatica
MENFPVINLEKLNGEERGTTMEKIKDACENWGFFELVNHGLPHELLDTVERLAKEHYKKCMEQRFKELVTAQGLEGVQTEVNDLDWESTFHVRHLPQSNISEIPDLEDEYRKVMKEFALKLEKLAEELLDLLCENLGLEKGYLKKAFHGSKGPNFGTKVSNYPPCPKPDLIKGLRAHTDAGGIILLFQDDKVSGLQLLKDGQWIDVPPMRHSIVINLGDQLEVITNGKYKSVLHRVIAQTNGNRMSIASFYNPGGDAVIYPATALVEKEAEEKNNVYPKFVFEDYMKLYAGLKFQAKEPRFEAMKAVESNVTVGPIATA

SEQ ID NO: 13708 - protein, 493 aa, Ralstonia metallidurans
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 13709 - protein, 616 aa, Oryza sativa
MASSKESDRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLPEAYFDCREYRRAAHVLRGQTGRKAVFLRCYALYTAGEKRKEEETVELEGSLGKSNAVNQELVALERELAAHRRTGAIDSFCLYLYGIVLRDKGSEALARTVLVESVNSYPWNWSAWLELQSLCTSSDILNNLNLKNQWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKNLERMEVEERQAQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 13710 - protein, 345 aa, Pseudomonas fluorescens PfO-1
MSEIDILSFGETMAMFVAEQSGDLAFIDQFHKRIAGADSNVAIGLSRLGFKVAWLSRVGADSLGRFVVETLAREGLDCSHVEVDPAHPTGFQLKSRNDDGNDPTVEYFRRGSAASHLSPQSITPKLLGARHLHATGIPPALSASAREMSRELMTRMRNAGRSVSFDPNLRPSLWAGEREMIREINRLAALAHWVLPGLSEGRLLTGFEDPADIAAFYLDQGAEAVAIKLGPQGAYYRTHLDQGFVAGVPVETVVDTVGAGDGFAVGMISALLEHQSFPEAVRRANWIGSRAVQSRGDMEGLPTRSELAVEFEAAIAGKSNRLSAAPTVSVEYTKPVGAGLPAMRP

SEQ ID NO: 13711 - protein, 240 aa, Zea mays; identical to SEQ ID NO: 3968

SEQ ID NO: 13712 - protein, 541 aa, Oryza sativa (japonica cultivar-group)
MARQEQQQHLQVLSALDAAKTQWYHFTAIVVAGMGFFTDAYDLFCISLVTKLLGRIYYTDLAKENPGSLPPNVAAAVNGVAFCGTLAGQLFFGWLGDKLGRKSVYGMTLLMMVICSIASGLSFSHTPTSVMATLCFFRFWLGFGIGGDYPLSATIMSEYANKKTRGAFIAAVFAMQGFGILAGGIVTLIISSAFRAGFPAPAYQDDRAGSTVRQADYVWRIILMLGAMPALLTYYWRMKMPETARYTALVAKNAKQAAADMSKVLQVEIQEEQDKLEQMVTRNSSSFGLFSRQFARRHGLHLVGTATTWFLLDIAFYSQNLFQKDIFTSINWIPKAKTMSALEEVFRIARAQTLIALCGTVPGYWFTVFLIDIVGRFAIQLLGFFMMTVFMLGLAVPYHHWTTKGNHIGFVVMYAFTFFFANFGPNSTTFIVPAEIFPARLRSTCHGISAAAGKAGAIIGSFGFLYAAQDPHKPDAGYKPGIGVRNSLFVLAGCNLLGFICTFLVPESKGKSLEEMSGEAEDDDDEVAAAGGGAAVRPQTA

SEQ ID NO: 13713 - protein, 241 aa, Triticum aestivum
KENLILMERYHYFASSCRQFGFSVKSLSELMQDERGSDGALATILDVLKRIHTIFFDSAVETALSSRDVRQVIKRVRQEVLQGCKLVFSRVFPSSSRPQDQFIWKMAEQLGAICSADVDSTITHVVAVDVGTDKARWAVKNNKILVHPRWIEASNFRWHRQQEEDFPVKVKKNEKDKENDVAAATGPANEKDKEDDVVAVGTDPANEKDKEDDVAPAATDPANEKDKENDVAAAVTDSTNS

SEQ ID NO: 13714 - protein, 153 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVL

SEQ ID NO: 13715 - protein, 179 aa, Dendrobium grex Madame Thong-IN
LTLTKCCMQRGSHFRSRSGSQEARSGSSMSRCNSMDTKFCYYNNYNVNQPRHFCKNCQRYWTAGGSMRNVPVGAGRRKNKHTGSVYRHTVITPDSLASLQVDGPDLVDHKPLSPFKVNGTILKFGPDAPLCESMASILNLGEQNLSSQLDFTAGAENREETSCSSACKPVKKKDITQHN

SEQ ID NO: 13716 - protein, 500 aa, Oryza sativa
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNGHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 13717 - protein, 493 aa, Rhodobacter sphaeroides
MERTGAIGAVLEAMDAPANLRVVARVLGWPFKWLGLPGDPALPPATRALTALGPAYIKFGQILSTRPDVVGPEMALQLQYLQDKLPPFPTSVAKALIEEELHLPVDRVFSEFSEPVAAASIAQVHRARLADTGVEVAVKVLRPGIERAFRTDIDAFYLAAQIIELLSPSSRRLRPTEVIRHFEGVVNGELDLRLESASAGEFAVNTEADAGFQVPKPVWNLSARQVMTIGWAEGLSLADNPALDAAGHNRTELGTRVLSLFLSHALRDGFFHADMHQGNLKVAANGDIIAYDFGIMGRLDEYTRRVYAEIIFGFIQRDYRRVAEVHFEAGYVPADRDIDEFARALRAVGEPIFGMDASRISMARLLAYLFEVTERFGMETRTELILLQRTMVVVEGVARSLDPHINIWQVARPIVEDYIRDNVGPKAVARDLLRTARILGRFGPRLPRLVEARLIRQGHPEVDEPPQRETHSMVWMLAGAGLTAAGVWIGSLL

SEQ ID NO: 13718 - protein, 136 aa, Oryza meridionalis
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSADAAAAFYVDARLVGATAAAPAAAVYTTRPDH

SEQ ID NO: 13719 - protein, 206 aa, Aspergillus niger
MAGTRNYDFLIKLLLIGDSGVGKSCCLLRFSEDSFTPSFITTIGIDFKIRTIELDGKRVKLQIWDTAGQERFRTITTAYYRGAMGILLVYDVTDERSFQNIRTWFSNVEQHASEGVHKILIGNKCDWEEKRAVSTEQGQQLANELGIPFLEVSAKNNINIEKAFYDLASDIKKGMDTSKSEQVGSQGVSIDQQGSGLNGSAGGKCC

SEQ ID NO: 13720 - protein, 1135 aa, Pichia angusta
MPGLVEAPVEPYARPVRTLVQLALDPDDGLEYVSLNSQVYELIYGDLSDNKTRFVSLQLLGSPLFVEYQLFRAELDSELPQDSIELHSPRLSSKYGSDFTLEKCIVVPVTKVLSLTSVIMSFPHDVYRLIEGISKERLLEIVASERGSDAGHILIRKTDFLKTLHGEVIHCEPVDQGFLSSDTNLVIVKQEGLKRGVNGNVNGSHPDPSEIPVSTPVDFSVSHLGLGDLTFDDTSIFSNLTLQPLELQIGFLKYSMLMDCTHILESSHEFDHEDDQLFACVCSSVLQKLGCFSGDLVQIQTCDCGAGIVCACDKSARRKITIRVFSLADPNDFDPEKLYLSPIFLNSIGNPRIVFVKRLASQRPNGDFVCEKLENHVPVAKEVVIARVASPITLDRTMQHLFLSNLKTYFESKHRVIVKDQYIPVPIDTVLAKSLFSTYNASGDETQPEIIPQGIPNELAWFKITDGTTETDDGKSLVAGKQYIIDPAKTRMIQSGVCSDKVPLSDGISYSQLRDYFELPRQFAYPCLRISNVLTFPYANQLRKIVSVAFRIRDNSYSRSRVQTTILLSSMARCVGKATLVRRIATEFGANLLELDAYDLLNQASVSKTIGTIRGKSDRVVDSCCSVILYIRHIEALAKKPDPNQQQKDSMSLRLAELIDEYTSKGAIFIGSTNDADAISELIRSKFKFDISINVPTEPERKLILTDLLDDMKTKDKTPVVLRPDVSLDTLALQSAGLTANDLVSIVDNTITIAIERLERLSEEQKVNWDQLLSFNGGRIKLTPEDFETSINDARNKFSDMIGAPRIPDVKWEDVGGLDVVKDEILDTIEMPLKHPELFSKGMKKRSGILFYGPPGTGKTLLAKAIATNFALNFFSVKGPELLNMYIGESEANVRRVFQKARDAKPCVIFFDELDSVAPKRGNQGDSGGVMDRIVSQLLAELDGMSGAEGGDGVFVVGATNRPDLLDEALLRPGRFDKMLYLGIADTHEKQAKIIQALTRKFQLDPSVDLGRIAETCPFTYTGADFYALCSDAMLNAMTRTAGAVEKKINEYNCNREEGDKISTRFWFDNIAKPEDTQVLVKSEDFAKARDELVPSVSAEELQHYLSVRENFEGGKTQDVMHTVPDGADIIISHD

SEQ ID NO: 13721 - protein, 296 aa, Aquifex aeolicus VF5
MKIGDILRKGVFSISFEFFPPKTEEGERQLFETIRKLEKLNPTFVSVTYGAGGSTRDRTRNIVQKIHEETNLTVMAHLTCIAHTREELIDILQDYKNIGIENILALRGDVPRDKPDWRPPKGACKYAKELVELIRKEFGDWFSIGVASYPEGHPESPNLEWEVKYFKEKVEAGADFSITQMFFVNDYYYRFVEMCKNAGIDISIIPGIMPITNFKQIRKFASLCGATIPQSLIEKLEKVEDKPEEVKKIGIEFAINQCLDLIEHGVPGLHFYTLNKSDATLKIYEAIKDKIPARST

SEQ ID NO: 13722 - protein, 1664 aa, ASPERGILLUS NIDULANS FGSC A4
MYWDLGVLLVHCRCGLAGHAATGPLCLRASIGSELRFEAIGSDVVSLDVSFRLLDKLQSEGARLAIAEQALHSASGFRSVCPAIPDFSSTLSTSGRKTFSLFQRVCGTSPWGIAERVWPPSPCAPREKGSDLYIPSETRSKAHASPLVTLAAGSQYRHIICDNSTMTSSINSRPAAGAVAHSSLARRTVGRPDDDPAALVLEAWSQGLMTGSLVIMAAVTFANMRPGVLLHKLILLELILAMAHGTFIFAPEPVYGCLISMTVTASANHGWTSDPWWIYTTCNIFWVVKTHYNFGILELVRECPRFGLMLASMCLSIVFIVLDVISVTGALDAAMPLGINPFWKCLCDTIILDDFKTALDKLSARWLARNGMNGVHASGNRPFVRNRIITPFSVFSAWWTAYADPHSLRPSSGTGASRSWEDHKHDAIGPATQEQGSRVPLDFWGMTVDSVPSGMGWFYYTYCFGLEPRAHSLLVTLSAFFGLVLTACKQPWSIRLQSPEQTMDPHSLPAHDTRRRRNALACNTCRRRRTKCDGKRPKCSFCVERGKDCFYQEPQDLPPSPLKAELSRIWEQLDHIAAIVQGRNPRSSPSPNEQQSHAPLTAPGAPQGFPFMTVQSEAFLILLGLDKYLPMHLEHVERGRQIISAKPSLESIVMVDLADASVLLHAFTEQIYIWYPILHADFTNEFLEAVTSCFPFSLSSCLTLLVLAIGCVVKCESIVDALQARPEAAYIQAASAMLPCVLADSSPRSAQCLLLFSIYHLCYAQPCQAHDFVVMASRKMQNYMLKCVERVPGRVSRTGDDVLTSASRSEPDIGNDTTIIGNCFWIALLIERYPDLRAKKSNLDKLTICSELRVQLDFVDSGIWNMALFAPAPTASSIWTWRELTPSLDSPGSFTSNESVDLSRSDDLSYFVAEIAMRKMLQRCTWATSTLAQGRHVYAPIVAVELERQLDEWLQLLPEPLSFRGRGSTCIGSRPLRNSDSAQVEFLRAQYYAFKASIYWPAVYEALLSSETDGNLIRHCAKFFSSYAEFVPSAAAAVAVCKPNLWTLCASVFTFSMATLLALTEPCLAEVVPQGVYLGLEVAVNVFDGLAEFAVEIDVNMNCRHTAKQQDKQHLRPRHLLPFCDRHKTMGILFKKPEGTEGKAWPAILISGFVAFGGILFGGILAMPYWAQTFSTGYRDSTGQLNVTSSQSSAIVSILSAGTFFGALGAAPVGDIIGRRWGLIASNGVFVLGVVLQTIATSIPPFLAGRFFAGLGVGLISALVPLYQSETAPKWIRGFIVGSYQFSITIGLLLASVLNNATHHRNDSGSYRIPIAVQFAWSIILVGGMLILPETPRYLIKRDDTKAAALSLSKLRRLPQDHESIRQELSEIQANHQFEVSLGKSGYAECFRGSLLKRLLTGCGLQALQQLTGINFIFYYGTQFFKNSGFKNEFVITLITNCVNVGSTIPGLYAIDKWGRRPVLLTGAIGMAVSQLLVAVLGTTTTGQDAQGNIIVHNAAAQKAAIAFICLYIFFFAASWGPIAWVVTGEIFPLKTRAKSLSMTTATNWLLNWALSFATPYLVNYGDGNANLQSKIFFIWFGCCFLCIGFVYFMIYETKGLTLEEVDELYLEVKSARESVSWSPKGTFARVAEKGNGSAGILERTEKGDVGGHREIGAPDGVSV

SEQ ID NO: 13723 - protein, 376 aa, Streptomyces alboniger
MAPTEATRGGPADPAPAPEAHRGGHTEHADPAEHAAQFGAQERILTLVWGYISSEILDLATRLDLPDLMGTEERAAAELAASLDTDPVATLRLLRAFAALGLAEETGAGRFRLTPAGHRLRTDVPDSLHAFVRQGMGVFRQAWSHFDHSIRTGEPAFDQVFGTDFFSYLSERPELSGTFTSSMREATRTMSTALAKEEEYDFSSYGTVVDIGGADGSLLAAVLSAHPGVEGVVFDSPEGARDAAATLDAAGVGERGRVETGDFFTRVPGGGDLYVLKSILHDWSDARSADILRTVRAAMPAHARLLVVEVLLPDTVDSSAHPLGYLSDLYMLVNMGGRERSERDLRSLLSDTGFRTTRVRTPPGLTPFSLIEAAPV

SEQ ID NO: 13724 - protein, 267 aa, Nicotiana tabacum
NSAHGGVYAHPGVPIGSHPPGHGMATSPAVSQAMDGASLSLDASAKSSENSDRGLLAMSLGNGSADNIEGGADHGNSQSGDTEDSTDGSDTNGAGVSERSKKRSRETTPDNSGDSKSHLRRCQPTGEINDDSEKAIVAVRPGKVGEKVMGTVLSPSMTTTLEMRNPASTHLKASPTNVSQLSPALPNEAWLQNERELKREKRKQSNRESARRSRLRKQAEAEELAIRVQSLTAENMTLKSEINKLMENSEKLKLENAALMERLKMNS

SEQ ID NO: 13725 - protein, 279 aa, Zea mays
MAARLRRSPISSPPPPPSLCISLYPPPHSSVETTYPACSTYLRSPAMTVLDAESRFHVLAVDDSIIDRKLIEMLLKSSSYQVTTVDSGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPNQKNKPQAQAVESPEQQLDPHPQPVHEPEEAAADRNGVNKRKAAAMEEGLTVVVTAPESTKPRRLSTSSLTVET

SEQ ID NO: 13726 - protein, 344 aa, Oryza sativa
  unsure (1)..(344): unsure at all Xaa locations
GEGGGGGEGSGCPWARPCDGCRXAPSVVYCRADAAYLCASCDARVHAANRVASRHERVRVCEACERAPAALACRADAAALCVACDVQVHSANPLPAITIPATSVLAEAVVATATVLGDKDEEVDSWLLNNDNNNSNSSNNGMYFGEVDEYFDLVGYNSYYDNRIENNQDRQYGKKEGSECVVPSQITMLSEQQHSGYGVVGADQAASMTAGVSAYTDSISNSVSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 13727 - protein, 436 aa, Oryza sativa
MASPLLLLLPLAVSSLLLPFAAAARVFSVADYGAAGDGARYDTGAIQAAVDACAAAGGGRVLLPAPGDYLTATVHLRSRVVLDVAPGARLLGGTRQADYPPESRRWYVVLAENTTGAGVTGGGEINGQGGAFVVTPNPQKNIMVSWNATGDCEGDECRPRLVGFIDSKDVTIHDITLNQPAYWCLHIVRCDNTMIHNVSIYGDFDTPNNDGIDIEDSNNTAITHCHIDTGDDAICPKSTTGPVYNLTATNCWIRTKSCAIKFGSASFFDFKKLVFDNITIVDSHRGLGMQIRDGGNVSDVVFSNIKMSTRYYHPLWWGRAEPIYITTCPRHPDSKEGTISDIQFINISSVSENGVFLAGSKHGLLRNLKFKNVDLTYKRWTNYSGGLYDYRPGCQKMVKHRTGGMMLEHISGLEIDNPSTVDKLSFHDWQSLAVSR

SEQ ID NO: 13728 - protein, 252 aa, Chondropsis semiviridis
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKDRMKKASEGNMKGIM

SEQ ID NO: 13729 - protein, 269 aa, Oryza sativa (indica cultivar-group)
MSSASSMEALHAAVLKEEQQQHEVEEATVVTSSSATSGEEGGHLPQGWAKRKRSRRQRSEEENLALCLLMLARGGHHRVQAPPPLSASAPPPAGAEFKCSVCGKSFSSYQALGGHKTSHRVKLPTPPAAPVLAPAPVAALLPSAEDREPATSSTAASSDGMTNRVHRCSICQKEFPTGQALGGHKRKHYDGGVGAGAGASSTELLATVAAESEVGSSGNGQSATRAFDLNLPAVPEFVWRPCSKGKKMWDEEEEVQSPLAFKKPRLLTA

SEQ ID NO: 13730 - protein, 259 aa, Triticum aestivum
MHGQPRRPKQPEDDAAAAAKAAKLRELQVQVLHNHHTCTYTEEALGLSFKLLEINPEAYTAWNYRKLALQHNLKELSDPEAIKSSVDAELRVVELALRQNPKSYGAWYHRKWLLNQKLAPVDFKREYGLLDKLLKVDARNFHGWNYRRFLAKFMGVPEEKELQYTMDKISENFSNYSAWHNRSILLSKLLIQRSEGFESKQKIFSEEFELVIQALFTDPGDQSGWFYHLWLLAQTSTPDNPQLISSWPSNGAKLSLFPT

SEQ ID NO: 13731 - protein, 332 aa, Neisseria meningitidis Z2491
MSRPVPAVFGSVFHSQMPVLAYREGKWQPTEWQSSQDLSLVPGAHALHYGSECFEGLKAFRQADGKIVLFRPTANIARMRQSADILHLPRPETQAYLDALVELVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 13732 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 13733 - protein, 668 aa, Camelina microcarpa
MAAATTTSSSSIPFSTKHSSSKSPLPISRFTLPFSLNPNKSSSSSSRRRGIKSTALSISAVLNTTTNVSTTTPQSKPTKPEKKKFVSRFAPDQPRKGADILVEALERQGVETAFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQIVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRAEELKLDFGVWRSELNEQKQKFPLSFKTFGEAIPPQYAIQVLDELTDGRAIISTGVGQHQMWAAQFYKYKKPRQWLSSAGLGAMGFGLPAAIGASVANPDSIVVDIDGDGSFIMNVQELATIRVENLPVKILILNNQHLGMVMQLEDRFYKANRAHTYLGNPAEEDEIFPNMLQFASACGIPAARVTKIAELREAIQKMLDTPGPYLLDVICPHQEHVLPMIPSGGTFNDVITEGDGRTKY

SEQ ID NO: 13734 - protein, 278 aa, Cetraria commixta
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 13735 - protein, 373 aa, Zea mays
  unsure (1)..(373): unsure at all Xaa locations
MRESSSISMELSPNNSTDQSLLDAQLELWHTTFAFMKSMALKSAIHLRIADAIHLHGGAASLSQILSKVHLHPSRVSSLRRLIRVLTTTNVFGTQPLAGGSDDDSEPVYTLTPVSRLLIGSQSSQLAQTPLAAMVLDPTIVSPFFELGAWFQHELPDPCIFKHTHGRGIWELTKDDATFDALVNDGLASDSQLIVDVAIRQSAEVFEGISSLVDVGGGIGAAAQAXISKAFPHVKCSVLDLAHVVAKAPTHTDVQFIAGDMFESIPPADAVLLKSVLHDWDHDDCVKILKNCKKAIPPREAGGKVIIINMVVGAGPSDMKHKEMQAIFDVYIMFINGMERDEQEWSKIFSEAGYSDYRIIPVLGVRSIIEVYP

SEQ ID NO: 13736 - protein, 268 aa, ASPERGILLUS NIDULANS FGSC A4
MYTAKRLSGKTILITGASSGIGRSTALEFARSSPDNLKLILTARRIDRLRELASEITSERPGVKVYPIHLDVSNPEEVNGLLGTLPSEFKEVDVLVNNAGLVKGVARAPEIAEEDIATMFSTNVHGLINMTQAILPSMLSRNNGQGAGDIINIGSIAGREPYVGGSIYCATKAAVRSFTEALRKELIASRVRIIAVDPGQVETEFSVVRFYGDKSKADAVYAGCEPLTPDDIAEVIVFTASRRENAVVADTLVYPNHQASATIMHRKN

SEQ ID NO: 13737 - protein, 519 aa, Arabidopsis thaliana
MNRGAQRYSNLAAAVENTITPPVKVEHTQLLIGGRFVDAVSGKTFPTLDPRNGEVIAQVSEGDAEDVNRAVAAARKAFDEGPWPKMTAYVYNKVVLCLSSERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 13738 - protein, 411 aa, Candida albicans
  unsure (1)..(411): unsure at all Xaa locations
MDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAXVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 13739 - protein, 60 aa, Oryza sativa
RPEQARIVEEAVACTDMALERGGAYIRAQGALSRMFDPDLILYIKRAVTIPFMAIARIGH

SEQ ID NO: 13740 - protein, 426 aa, Magnetospirillum magnetotacticum
MILLMFGVGLHFSIGDLLTVRAIALPGAIVQIGVATAMGAGLAWAFGWGAGAGLVFGLALSVASTVVLLRALEGQGLLDTDKGRIAVGWLIVEDLAMVVALVLLPALAPSLGGEAMSGSAQHGASAGLWVTLGLTLAKVSVFVAVMLVGGRRLVPYLLGLAARTGSRELFTLAVLASAVGIAFASSELFGVSFALGAFFAGMVLAESDLSHQAAADSLPLQDAFAVLFFVSVGMLFDPGIVLRAPLSILGVVGVIVLGKSLAAVAIVLAFGHPVGTALTIAASLAQIGEFSFILAGLGIALKLLPEEGRDLILGGALLSITLNPLFFVLSDRVSRWLGERPELRRRLERRSPAPPPLNNAAQGLRDHTVIIGYGRVGSAIGQALQDWNLPFVVVERDRRRVEDLRAQGVPAVFGDATAPGILDADD

SEQ ID NO: 13741 - protein, 245 aa, Pinus radiata
MGRGKVELKRIENKINRQVTFAKRRNGLLKKAYELSVLCDAEVALIIFSNRGKLYEFCSSSSMMKTIEKYQKCSYGSLETNCSINEMQNSYQDYLELKARVEVLQRSQRNLLGEELGPLNSKELEQLEHQLENSLKQIRSAKTQFMFDQLAHLQHKEQMLVEANRELRKKLEESNTRIPLRLGWEAEDHNNISYRRLPTQSQGLIFQPLGGYPNMQIGYNPAGSNELNVSPADQHPNGFIPGWML

SEQ ID NO: 13742 - protein, 314 aa, Haemophilus influenzae Rd
MKKIAFIGECMIELNGKPFAEMWQSYGGDTLNSATYLSRVSSSKEIQVHYVSALGTDNLSKQMLKYWQADGIQTNWVLQDEQHQPGLYLIQLDAQGERTFLYWRNQSAARYMVQHPDFAKVIAELQQVDVIYLSGISLAILPKNDRTFLIEQLSSLAKKGTEIVFDSNYRPKLWDSLEEAQDCYLQLLPSVNIALVTFDDEQALWKDKTSRDTLERLHKIGIPKVIVKCGKNGAIFSDRYLSQYGQVIPEPILNVVDTTSAGDSFNAGFLNGYLRNKSLEICCQQGNRIAGIVIQHKGAIIDKVAISHLQSEFN

SEQ ID NO: 13743 - protein, 840 aa, Citrus hybrid cultivar
MADAKANGKNEAAKLAKIPAAANPLANEPSAIASNISYHVQYSPHFSPTKFEPEQAFFATAEVVRDRLIQQWNETYHHFNKVDPKQTYYLSMEFLQGRTLTNAIGSLDIQNAYADALNNLGHVLEEIAEQEKDAALGNGGLGRLASCFLDSMATLNLPAWGYGLRYRYGLFKQKITKQGQEEVAEDWLEKFSPWEVVRHDVVFPVRFFGSVMVNPNGTRKWVGGEVVQAVAYDIPIPGYKTKNTISLRLWDAKASAEDFNLFQFNDGQYESAAQLHSRAQQICAVLYPGDSTEEGKLLRLKQQFFLCSASLQDMILRFKERKSGRQWSEFPSKVAVQLNDTHPTLAIPELMRLLMDEEGLGWDEAWDITTRTVAYTNHTVLPEALEKWSQAVMWKLLPRHMEIIEEIDKRFIAMVRSTRSDLESKIPSMCILDNNPKKPVVRMANLCVVSAHTVNGVAQLHSDILKADLFADYVSLWPNKLQNKTNGITPRRWLRFCNPELSKIITKWLKTDQWVTNLDLLVGLRQFADNTELQAEWESAKMASKKHLADYIWRVTGVTIDPNSLFDIQVKRIHEYKRQLLNILGAIYRYKKLKEMSPQERKKTTPRTIMFGGKAFATYTNAKRIVKLVNDVGEVVNTDPEVNSYLKVVFVPNYNVSVAELLIPGSELSQHISTAGMEASGTSNMKFSLNGCLIIGTLDGANVEIRQEIGEENFFLFGAGADQVPKLRKEREDGLFKPDPRFEEAKQFIRSGAFGSYDYNPLLDSLEGNTGYGRGDYFLVGYDFPSYLEAQDRVDQAYKDRKKWLKMSILSTAGSGKFSSDRTIAQYAKEIWNITECRTS

SEQ ID NO: 13744 - protein, 217 aa, Pimpinella brachycarpa
MVRGKTQMRRIENATSRQVTFSKRRNGLLKKAFELSVLCDAEVALIIFSPRGKLHEFASSSMHETIERYRKHTKDVQSNNTPVVQNMQHLKHETASLAKKIELLEVSKRKLLGEGLGTCSINELQQIEQQLEKSVCTVRARKMQVFKEQIEQLKEKEKTLAADNAILLAKYDVQPRQESPEDGGNLTSTTENSENSDVETELFIGPPEKRFKRIMEK

SEQ ID NO: 13745 - protein, 180 aa, Solanum tuberosum
MASSVMSSAAVATRGNGAQASMVAPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 13746 - protein, 446 aa, Zea mays
  unsure (1)..(446): unsure at all Xaa locations
MGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDRSKVDDLRGTPMNVGSLEEIIDESHAIVSSSVGPEYYVGILSFVDKDQLEPGCAILMHNKVLSVVGILQDEVDPMVSVMKVEKAPLESYADIGGLDAQIQEIKEAVELPLTHPELYEDIXTHASAHASAHASAGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 13747 - protein, 576 aa, Listeria monocytogenes EGD-e
MKKVKASETLVQTLKNWGIDHVYGLPGDSIDTVVDALRKEQEAIEFIHVRHEEVATLAAAAYTKLTGKIGVALSIGGPGAIHLLNGMYDAKMDHVPMLVLAGQVTTDVLNTGFFQEVNLPAIFEDVAVYNKQIDNAETLADVVDEAIRTAYKEKGVAVLTIPNDIPSQVIKASLEAKPVKFEQENPKLDEAAIQEAVTLIEKAEKPVILAGLGTKHAGPELIAFSEKLKIPIIHSLPAKTIVPDDHPNALGNLGKIGTKPAYEAMQETDLLLMFGNDYPYSDYLPKKTDCIQIDIDPAKISKRFPAIVGLVGDAAEIISDLTAKIAPVEERKFLQACQENMQEWWKWLEEDIAQTSDPIAPEVVMANIQKIADKDAVFSIDVGTATVWSTRYLHLTPENDFIVSAWLGTMGCGLPGAIAAKKAFPDRQAIAIVGDGGFSMVMQDFVTAVGLNMPMIVVVLNNQQLSFIKYEQQSAGELNYAIDLPDINYAKFAESCGGIGFRVEKMADLEAAFENAKLATKPVIIDVSVDSAAAPLPGKIVMDEALGYTKFEIQSVLEDHRFAKMPPLKTILRRFL

SEQ ID NO: 13748 - protein, 276 aa, Triticum aestivum
  unsure (1)..(276): unsure at all Xaa locations
RPAVGPPGFPAPLGPLRPKGALFCIDYFALRSQQYKWLEQFAEEYQCDNSLWLFPNFSFSLAIARFYLERDAEDVSDHADKSTAVDLMKQALMLHPLVLSKIVDKAPLKDSSWTQILKNAFFGSAKPGSPSLEHVINIYVERHYIMWRFPELQNLLKEAALLVIESLKXDSREAQDWACVRKEAFSSEKNEYSHLLVSDFSDTTPSLPPEELRPFMVGPGMXHDMPPVEQEAGPERIHAPLEVVGRNAARVFLESLLPWVNYGDNRHGGNDQPDDD

SEQ ID NO: 13749 - protein, 159 aa, Frankia sp. FE59
ITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTV

SEQ ID NO: 13750 - protein, 232 aa, Oryza sativa
  unsure (1)..(232): unsure at all Xaa locations
QALACGAIGAVIVNRVIQKQLGDLLSSEAAKIASAEXGQMPQQVWNFFXDIAGPTGAQLQIVYGXVFGYMQVLSACFMSFAHGGNDVSNAIGPLAAXLSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVASWLVTIPVGAVLSIFYTLLFTKILAYFM

SEQ ID NO: 13751 - protein, 368 aa, Oryza sativa (japonica cultivar-group)
METLSMLKVGYTLLRSETPATDLVNAFMDWAARRSLLLLAVFVPPYLAYRLASSALAAASPEDVAGKVVLVTGASSGIGEQVAYRYARRGARLALVARREASLGEVAARARALGSPDVLAVPGDVARPDDCRRFVQATVEHFGRLDHLVNNAGLANVCWFEEVPDVANFKQVLDVNFWGTVHPTHAALPHLKASRGKIFVNSSASAVLAMPRMSFYNASKAAVHNFAETLRMELHGEVGVTVATPGWVDSEMTKGKHLSSHGAMEVDQDTRDAQVGVFPVERGERCAEAIVDAVARGRRRVTSPAWYGALFLWRTMAPEVADACQRVFYHRRSSAAGGGGRARAALEATGAKAVLQPPSLRSSEIKVE

SEQ ID NO: 13752 - protein, 178 aa, Glycine max
  unsure (1)..(178): unsure at all Xaa locations
MASSMISSPAVTTVNRAGAGMVAPFTGLKSMAGFPTKKTNNDITSIASNGGRVQCMQVWPPIGKKKFNTLSYLPDLNNTQLAKEVEYLLKKRXIPYLQFDLNHNFIYHNHNESPRYYNKLYXTIXNLPIFNYTNTSHVCKDLQXTKTTYPSNCIPIIRFYNSHQXQYINFISYXPAXF

SEQ ID NO: 13753 - protein, 170 aa, Metroxylon sagu
MGVYVFKRDVLLKLLRWRYPKSNDFGSEILPSAVKERNVQAYLFNDYWEDIGTIKSFFDANLALTDQLPKFQFYDPRTPFFTSPRFLPPTKIKKCRILDAIISHGCFLRECSVQHSIVGVRSRLDYGADLKDTMMMGADSYETEAEIASLLAEGKVPIGVGQNTKISNCI

SEQ ID NO: 13754 - protein, 237 aa, Glycine max
IRLEALDMGIIQKADYERINKVMVPACEMAIKLCGTDGKIACTASYFVCNTIFNSIMSHAGDINYYDIRKKCEGSLCYDFSNLEKYLNQKSVRDALGVGDIDFVSCSSTVYQAMLVDWMRNLEVGIPALLEDGINMLVYAGEFDLICNWLGNSKWVHAMEWSGQQEFVVSSEVPFTVDDSEAGLLKKYGPLSFLKVHDAGHMVPMDQPKASLEMLKRWTQGTLSESAADAEKLVAEL

SEQ ID NO: 13755 - protein, 347 aa, Arabidopsis thaliana
MGCSFSGLNALYDAVNGGGDVWINENRFRIVRQLGEGGFAFVFLVKEIVADASSAASGGGLAKKVKDPAHLSADGTYAMKKVLIQNKEQLELVREEIRVSSLFNHPNLLPLLDHAIISVKDGQEGAWKHEAFLLFPVHLDGTLLDNFTLMKAKKETFSTTDVLHIFRQLCDGLKHMHSLEPPYAHNDVKPGNVLLTRRKGQPPLAILMDFGSARPSRKQIRSRQEALQLQEWTSEHCSAPFRAPELWDCPSHADIDERTDIWSLGCTLYAIMYGVSPFEYALGESGGSLQLAIVNAQIKWPNTGPKASYPEALHQFVTWMLQPQAAVRPRIDDIIIHVDKLIAKFTK

SEQ ID NO: 13756 - protein, 129 aa, Salmonella enterica
CHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 13757 - protein, 358 aa, Cordyceps bassiana
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLDGKPLFPGKDHVNQFSIITELLGTPPDDVINTIASENTLRFVKSLPKRERQPLRNKFRNADDSAIDLMERMLVFDPKKRITAAEALSHDYLAPYHDPTDEPVAEEKFDWSFNDADLPVDTWKIMMYSEILDYHNVEAGASGLEDGSVPAQ

SEQ ID NO: 13758 - protein, 318 aa, Zea mays
MAGLSLLHPMAFAFGLLGNIISFMTYLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSLSLTVSAVVWFLYGLLIKDKYVALPNVIGFSFGVVQMGLYALYRNATPQGACQGRGRRRQQGQGARRTCGGHHCQADRRRRRHLQLPWAEDLVKVHDGHPGGSSQGRRQAGGERRGTQRRRASLDSSLDQIRIHEEEHAYVCVSGRS

SEQ ID NO: 13759 - protein, 549 aa, ASPERGILLUS NIDULANS FGSC A4
MSSPLVKVLHRMQALFSNIVAALETMLLFPSLFRDSSRGGGKSRAAFRRRRALDALADEIEIIFSKPLTLKNMLAMSEKIREQFRAGLESSPINMLPSYNHALPTGLEQGTFLALDVGGSTMRVALIELCGQGKMEVLRVSSSLIDNDVKLLEGTSFFDWMAEKIEEMLREVGTNYGREEAPLSMGLSWSFPIEQTSISSGLVIHMGKGFRCSMGTVGQELGSLIVQSCQKRGLNVRVDAIVNDSSAALLSRAYVDPTTRMSLILGTGTNVAIHFPVHAIGLGKFGKRPQGWFDYAKHVIINSEMSMFGGGVLPMTRWDDILNRTHLRPDYQPLEYMATGRYLGEIVRLIIVDAVETAQLFGGELPHSMRDAYSLDTSIVAFIEADTSPFLTASAALLQKEHTMSRPPSPEDLRFLLRVCRTISKRAAGYLATAIHSMWCLRNEAEISQGPPSPSFKGPRDVTVTESGSNSDCLSIACDGSVINKYPGFRDRCQAYLDQLTQETNTSKVSQISEEGSCIRLEPAPEGAIFGAAVAVAVAVAGKLEQTIV

SEQ ID NO: 13760 - protein, 320 aa, Pelargonium x hortorum
MEKFPVINLEKLNGEGRAETMDKIKDACENWGFFEVLNHGIPYELLDTVEKMTKEHYKKCMEQRFKEMVTSKGLDGVEAEVEDMDWESTFFLKHLPESNISQVPDLQDNYRKVMKEFALKLENLAEELLDLLCENLGLEKGYLKKAFYGSKGPTFGTKVSNYPPCPKPDLIKGLRAHTDAGGLILLFQDDKVSGLQLLKDGNWVDVPPMHHSIVINLGDQLEVITNGKYKSVEHRVIAQSDGTRMSIASFYNPGSDAVIYPAPALLAKETEEKQVYPKFVFEDYMKLYSGLKFKAKEPRFEVMKAREDNINVTLDPIATS

SEQ ID NO: 13761 - protein, 429 aa, GIBBERELLA ZEAE PH-1
MLRFRDMPKSRYRNVEQVQPERTRKSAYAERNAAIAKENEDEGQEAAPVPDRSHIDELVVTGRGFEAVKAIASVKDRIDDKTSVCLLNDGIGVLEQVRKMIFDGTQPEPNFFLGHMSHALVFNRNRDSVKQLKAGRTILTSADAALNTPKDLHASLDCNVPTFMQSLRHAELLQSSYSTYDQWLRFKLPSLMFTAAVEPVCVLLDLPYRGLTTNRSAQKMMNQLLGEMALVTESLPEVQNSPDLIRFLRGEGLKKFCYRRITGKANAPSELLMRINKGLQTDINYQNGFFLNRAVDLGIHTPTNKLMIRKARLEQLKAQGGGSSGGGGSGQEQQQRQQQQQDDARQHVLNQILHPEAADRLGRIRLVKESRAADIENRLITLAQTGQLRQKVTEAQLKELLNAMSESKEEEKIVVSRRKAWDDDDDLDL

SEQ ID NO: 13762 - protein, 264 aa, Gossypium hirsutum
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPATHRPLNEASQDVTTISFSGAKEEKEKINTNSNNNPIGFITKDEKKIPVQERCPDLNLDLRISPPYYQQTQPESFKTGGRTLCFICSLGVKNSKDCTCSTITTAAGSSSSSSSHSNSNNSSGYDFLGLKSGILEYRSLEMK

SEQ ID NO: 13763 - protein, 345 aa, Glycine max
EMGVKMYSDMVTLQTMDSIFYEVQRQGRISFYLTQMGEEAVNIASAAALSPDDIILPQYREPGVLLWRGFTLQQFVHQCFGNTHDFGKGRQMPIHYGSNKHNYFTVSSPIATQLPQAVGAAYSLKMDGKSACAVTFCGDGATSEGDFHAAMNFAAVMEAPVVFICRNNGWAISTPVEDQFRSDGIVVKGKAYGIWSIRVDGNDALAVYSAVHTAREIAIREKRPVLIEALTYRVGHHSTSDDSTKYRGTGEIEYWKTARNPVNRFKRWVERNDWWSDKDELELRSSVRKQLMHAIQVAEKAQKPPLEDLFSDVYDQLPSNLQEQERLLRKTIQKHPKDYPSDVPL

SEQ ID NO: 13764 - protein, 117 aa, Triticum aestivum
SVVAAEVLGGIPLLVISVLNHDPALNGHIQELTWSDIAALGYTSIFGSAVSYGVYFYNATRGSLTTLSSLTFLTPMFASIFGFLYLGETFAPEQIGGALLTLVAIYMVNYKSIIGEK

SEQ ID NO: 13765 - protein, 548 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSL

SEQ ID NO: 13766 - protein, 493 aa, Zea mays
MRTLAPRPSQSRSLQQPRNLCRALHTGVQAAPGPALMNLAAFSSTLATLPWYEMPSINSSATFSSSLLRRSLCASLRTISHMASAAAPTSAPVATTENGAAKAIEQRPVQVAERLEKFKTTIFTQMSMLAIKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELEAAVSKDTKAIMINTPHNPTGKMFTREELESIAALCKENDVLLFSDEVYDKLVFEADHISMASIPGMYERTVTMNSLGKTFSLTGWKIGWAIAPPHLTWGLRQAHSFLTFATCTPMQAAAAAALRAPDSYYDELKRDYSAKKAILLEGLEAAGFIVYPSSGTYFIMVDHTPFGFDNDIEFCEYLIREVGVAAIPPSVFYLNPEEGKNLVRFTFCKDEDTLRGAVERMKTRLRKK

SEQ ID NO: 13767 - protein, 194 aa, Xylella fastidiosa Ann-1
MLLMLDNYDSFTYNLVQYLQTLGAEVMVIRNDAMTVEQIAALKPERIVISPGPCTPNEAGVSLKLIEQLGSSTPILGICLGHQSIGQAYGGDVIRATNIMHGKTSAIYHNGKGVFVGLPNGYDATRYHSLVVDKTTLPDVLEVTAWTENQDGTIEEIMGLRHREYFVEGVQFHPESILTAHGHALLKNFLEHPL

SEQ ID NO: 13768 - protein, 503 aa, Gossypium hirsutum
MAVQVPSRQLFIDGEWREPILKERLPTINPATEEIIGNIPAATAEDVELAVAAARRALSRNKGKDWATAPGAVRAKYLRAIAAKVTERKTELAKLEAIDCGKPLDEAVWDIEDVAGCFEYYADLAEGLDARQKAPVSLPMETFKSYVLKEPIGVVGLITPWNYPLLMATWKVAPSLAAGCAAILKPSELASITCLELAKVVKGSRLPPGVLNILAGLGPEAGAPLASHPDVDKIAFTGSSATGSKIMAAAAQMVKPVSLELGGKSPIIVFEDVDLDKAAEWTAFGCFWTNGQICSATSRLIVHENIAREFLDRLVKWTKNIKISDPFEEGCRLGPVVSGGQYEKVLKFISTAKSEGATILSGGVRPEHLKKGFFVEPTIITDVTTSMQIWREEVFGPVLCVKTFRTEEEALELANDTHYGLGAAVISNDLERCDRVSKNLQAGIVWVNCSQPCFCQAPWGGNKRSGFGRELGEWGLDNYLSVKQVTQYVSDEPWGWYRSPSKL

SEQ ID NO: 13769 - protein, 368 aa, Agrobacterium tumefaciens str. C58
MFDASITIRGGTTMFTTSAYACDDGSSPMKLATIRRRDPGPRDVEIEIEFCGVCHSDIHTARSEWPGSLYPCVPGHEIVGRVGRVGAQVTRFKTGDRVGVGCIVDSCRECASCAEGLEQYCENGMTGTYNSPDKAMGGGAHTLGGYSAHVVVDDRYVLNIPEGLDPAAAAPLLCAGITTYSPLRHWNAGPGKRVGVVGLGGLGHMAVKLANAMGATVVMITTSPGKAEDAKKLGAHEVIISRDAEQMKKATSSLDLIIDAVAADHDIDAYLALLKRDGALVQVGAPEKPLSVMAFSLIPGRKTFAGSMIGGIPETQEMLDFCAEKGIAGEIEMIDIDQINDAYERMIKSDVRYRFVIDMKSLPRQKAA

SEQ ID NO: 13770 - protein, 512 aa, Oryza sativa
MEERLADVEGSFACNSRGEDDFRSCCGDEDEWEDTEESFTAGVAKGELDESSVRLFFKGVSSPEAEGKKLSGIGVVMERSPGVPMLQVQKKLDFYVDELVADHLALMDGLLVALQNGIRKIFAFTNSEKLYFQARIAEAEILEDQLLVALGHRILELVEKLEDFDIILLPSFELERPLQLAKEAIGIMYLSPYEVGTCSICCEEKRGAQMIKVGCAHTFCYSCLTSYTQEKLQTNKVPIRCPQLRCKYHISASECKSFLPVSCYDSLGGAFAEAGASDMERFYCPFPNCSVLLDLSQHFSRASTSSQSDLNCVECPECHRDICINCGVPWHVMMGCDEYQSLPVDERDAGDLSLHRLAQNNRWRRCQRCRRMIELTQGCFHMNCWCGHEFCYSCGAEYTNGIQTCQCVFWDEESIEAASAAHSTQASEIWAWDTFDCMPTAIEGYSEQERAQLALIQRFLSGGFNLGEPPSQSPPRCADSYIIDTMKDLHQLPWLERFVSVISDSYNEDYIQ

SEQ ID NO: 13771 - protein, 210 aa, Heuchera americana
  unsure (1)..(210): unsure at all Xaa locations
SVLCDAEVALIVFSNRGKLYEFCSTSNMLKTLERYQKCSYGAVEVNRPCKELESSYREYLKLKGKFEGLQRTQRNLLGEDLGPLNTKELEQLERQLDSSLKLIRSTRTQFMLDQLSDLQNKEQVLMDSNRSLARKLDEISAKNNNLRLSWEGGEQSIPYSQQQAQPQGLFQPLDCNPTLQIGYNSIGSDPDDYXQLMHRMSTGFMPSWML

SEQ ID NO: 13772 - protein, 357 aa, Populus deltoides
MGSLETERKIVGWAATDSTGHLAPYTYSLRDTGPEDVFIKVISCGVCHTDIHQIKNDLGMSHYPMVPGHEVVGEVVEVGSDVTRFKVGDVVGVGVIVGSCKNCHPCKSEIEQYCNKKIWSYNDVYTDGKPTQGGFAESMVVHQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGVASMIEVIKMDYINTAFERLEKNDVRYRFVVDVAGSKLIH

SEQ ID NO: 13773 - protein, 170 aa, Oryza sativa
MGGSKDEQQDRGLFSNLMHGVAGGGGGHGYPYPPQQGYYPPPPTAYPPPPPAGYGGGYGYPPAGYPGSSAPFQHGNHGGGNMGMLAAGAAAAAAAYGAHKLSHGHGHGGYGYGGHHGGLFGGHHGHHGGLFGGHHGHHGGGLFGGHHGHHGGLFGGHHGFGGHHGHHGHH

SEQ ID NO: 13774 - protein, 602 aa, Lactobacillus gasseri
MTKISGSDAMFQVLYDWGIDHIYGFPGGSFDSTMNAIHNWRNKIKFIEVRHEEAGALAASAEYKISGKVGVCFGSAGPGAVHLMNGLYDAKYDKTPMVAIVANVPTSRQDIDFFQAFDEKPWFDPVAVWNHQAKTAESIPVLMDEAIRQAYQRKGPAVLILPKDFGWDKIEDNFRNNAAAHKVVPNFPAPRKEQVDKALELIKNAENPIVYFGHGAEDASAELKEFSDKFKMPLVSSVLGKGIVEDEFPAYMGSIGRVGAKPSNDIQTHADLVVWVGNNSPFSVFFFNPKAKVIQIDINSERLGKRHAVTVPMLADAKKTLRALIEAGESRSESPLYKAALADRENWEAWLESFNDSDEIPMRVEPIFDVINKKAADDAVFAVDVGNVNINFDRLMHLHGDQKWTTSGLYATMGYGAPASLAAATIYPNREVWNLAGDGGFAMMNQELLTQARYNMHVINVVFTNETLGYIEAEQVDESHQPLSGVKLPDNDWAMSAEGMNVKGFTVRNKKEFEDAVTAAQKMEGPVLIDCKITHDMPYSTELNTLDDPAFVAKYDAQALKPFSYFAGKYGVEADAASGASEHTEAEPVEAEEDASSGASRH

SEQ ID NO: 13775 - protein, 441 aa, Antirrhinum majus
MGSRHQVVQQQNRGDVVPGAIKQKSMAVEKKNRRALGDIGNVVTVRGVEGKALPQVSRPITRGFCAQLIANAEAAAAENNKNSLAVNAKGADGALPIKRAVARVPVQKKTVKSKPQEIIEISPDTEKKKAPVLEKEITGEKSLKKKAPTLTSTLTARSKAASVVRTKPKEQIVDIDAADVNNDLAVVEYVEDMYKFYKSAENDSRPHDYMDSQPEINEKMRAILIDWLVQVHYKFELSPETLYLTINIVDRYLASKTTSRRELQLLGMSSMLIASKYEEIWAPEVNDLVCISDGSYSNEQVLRMEKKILGALEWYLTVPTPYVFLVRFIKASLPDSDVEKNMVYFLAELGMMNYATIIMYCPSMIAAAAVYAARCTLNKMPIWNETLRMHTGFSEVQLMDCAKLLIDFHGGSTDQKLQGIYRKYSRLEKGAVALLPQPLLA

SEQ ID NO: 13776 - protein, 170 aa, Zea mays; identical to SEQ ID NO: 2818

SEQ ID NO: 13777 - protein, 128 aa, Oryza sativa
MADPELEAIRQRRMQELMAQHGAANPQNAGQQKAQEDAKQEAEERRQMMLAQILSSEARERLSRIALVKPDKARGVEDVLLRAAQSGGISEKVSEERLISLLEQINTHTSKQTKVTIQRRRSVLDDDD

SEQ ID NO: 13778 - protein, 252 aa, Glycine max
MDGGGVNYNPRTVEQVFRDFKGRRAGMIKALTTDVEEFFQQCDPEKDNLCLYGFPNEQWEVNLPAEEVPPELPEPALGINFARDGMQDKDWLSLVAVHSDAWLLAVAFYFGARFGFDNADRKRLFSMINDLPTIFEIVTGSAKKQTKEKSSISNHSSNKSKSGSKGRGSESGKYSKETKDEEEEVLDEEDDEEHEETLCGACGEHYASDEFWICCDICEKWFHGKCVKITPARAEHIKQYKCPSCSNKRARP

SEQ ID NO: 13779 - protein, 599 aa, Caulobacter crescentus CB15
MAQEVSPESYKDLVLFLATAGIVAPIFKRLKINPILGYLLAGVILGPFGLGRFIPYAPWLDYFTVDNPDEIAQLAEFGVVFLLFMIGLELSWERLRLMRRWVFGLGAVQVIGCSLALGAGGMLLGLEPVVALTIGAALTLSSTAIAVPVLAERRRLHSEAGRATFSVLLFQDLAVAPILITLAILGRGNGSFQLQDLLALAPAALGLAVIVLVGRLALRPMLKSVAKAKSEEMFMAACLLVIIGAGMVAALSGLSMALGAFVAGVLLAETEYRHEVEVKIEPFKGLLLSLFFVSLGIRLDLSLLAAQPAAILGTALGLLVLKTAVVFGSGLLMGLNRRAAIEAALILAAGGEFAFVLLDNAMSAQVVPPAIGQAVLVSATLTMFLIPGLAALGGYLGRKNAPLPVSEAPPSTANEPDRLGPEPAGQVLVIGYGRVGRLVGDMLGRHDLPWIAVEREARLVEQGRRDGARIYYGDASRLELLERCGLATARAVVVTMDAFEVAEAVVVAARGARPDVPIVVRARDARHAARLYELGATDAVPETIEASLQLSEAVLVDIGVPMGLVIASIHERRDEYRKKLNRPDALGGRRRRLRDATLR

SEQ ID NO: 13780 - protein, 406 aa, Arabidopsis thaliana
MDLVSSRDTLGDPSTSTKALLLGFSRSRSDHCIIMSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 13781 - protein, 361 aa, Schedonorus arundinaceus
MGSVDASEKTITGWAARDTTGHLSPYTYTLRRTGAEDVVLKVLYCGICHTDLHQTKNHLGASKYPMVPGHEVVGEVVEVGPEVSKYSVGDVVGVGVIVGCCRDCRPCKANVEQYCNKKIWSYNDVYTDGKPTQGGFASAMVVDQKFVVKIPAGLAPEQAAPLLCAGVTVYSPLKHFGLMTPGLRGGILGLGGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETEEVLRFCVEKGPTSQIEVVKMDYLNHALERLERNDVRYRFVVDVAGSNIKDADA

SEQ ID NO: 13782 - protein, 338 aa, Salmonella typhimurium LT2
MQKKSIYVAYTGGTIGMQRSDKGYIPVSGHLQRQLALMPEFHRPEMPDFTIHEYAPLMDSSDMTPEDWQHIAADIKAHYDEYDGFVILHGTDTMAFTASALSFMLENLGKPVIVTGSQIPLAELRSDGQINLLNALYVAANYPINEVTLFFNNRLFRGNRTTKAHADGFDAFASPNLPPLLEAGIHIRRLNTPPAPYGSGELIVHPITPQPIGVVTIYPGISAEVVRNFLRQPVKALILRSYGVGNAPQNKAFLQELKEASSRGIVVVNLTQCMSGRVNMGGYATGNALAHAGVIGGADMTVEATLTKLHYLLSQGLDTQAIRSAMAQNLRGELTPDD

SEQ ID NO: 13783 - protein, 204 aa, Glycine max
MATSENNNARPQRVAKKRAAAAICELHRNAAKRKRVVLGDLTNVSSNYVAVTEKEIQKQKKVKREQPARPVSTPEKVEERHDPQLCGPYVSDIYEVFRVMEVDPSKRPLPDYVQKVQRDVNANMRGVLVDWLVEVAEEYKLVSDTLYFCVAYIDRFLSLNALSRQKLQLLGVASMLIASKYEEIKPPDVEDFCYITDNTYSKGK

SEQ ID NO: 13784 - protein, 265 aa, Arabidopsis thaliana
MNYSNNYIEHQNKKKTIIIFFRQFKKQKPMLRMGVHLVVINKNTFNFFNRQNNYFNSGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 13785 - protein, 390 aa, Olea europaea
MALKLCFPPHKMPSFPDARIRSHRVFMASTIHSPSMEVGKVKKPFTPPREVHVQVTHSLAPEKREIFNSLNNWAQENILVLLKDVDKCWQPSDFLPDSASEGFDEQVMELRKRCKEIPDDYFIVLVGDMITEEALPTYQTMLNTLDGVRDETGASLTPWAIWTRAWTAEENRHGDLLNKYLYLSGRVDMKQIEKTIQYLIGSGMDPRTENNPYLGFIYTSFQERATFISHGNTARLAKEHGDLKLAQICGIIAADEKRHETAYTKIVEKLFEIDPDGTVLALADMMRKKVSMPAHLMYDGQDDNLFENFSSVAQRLGVYTAKDYADILEFLVGRWDIEKLTGLSGEGRKAQDYVCTLPPRIRRLEERAQSRVKKASATPFSWIFGREINL

SEQ ID NO: 13786 - protein, 423 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDT

SEQ ID NO: 13787 - protein, 448 aa, Oryza sativa (japonica cultivar-group)
MEEEAAVARLGCDQVLSILHLLPAESVLSFAAACRAFHAWASSDALWEALCRRDWGARATAALAERRRRGGGGVPWRRIYAEVALLGALSARRVPVKGASPRPRASHSLNLVAGWLVLFGGGCEGGRHLDDTWVAYVGNGAGNRSSAVFSWQQLDSGTPSGRFGHSCSIVGDALVLFGGINDQGQRLNDTWIGQIICEESRRMKISWRLLEVGPHAPYPRGAHAACCVDDKFIVIHGGIGQSGSRLGDTWLLDLSNGLRSGIWHQIEDTEPLPLSRSGHTLTWIGGSRMVLFGGRGSEFDVLNDVWLLDINERYPKWKELKYDLSSVLGEMPFPRVGHSATLVLGGKILVYGGEDSQRRRKDDFWTLDLPALLQFESGSKKMTKRMWKKLRIDGQCPNYRSFHGACVDTSGCHVYIFGGMVDGLVHPAEASGLRFDGQLYQVDLVLHL

SEQ ID NO: 13788 - protein, 197 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 13789 - protein, 259 aa, Triticum aestivum
MDMELDAARHGFAKMGFGCKHYRRRCRIRAPCCNDVFHCRHCHNYSTKDGHELDRHAVESVICLVCDTEQPVAQVCSNCGVCMGEYFCRACKFFDDDVDKEQYHCKDCGICRVGGKDNFFHCHKCGSCYSVTLRDKHVCIEDSMKNNCPICYEYLFDSLREASVLRCGHTMHLQCFHEMLKHDKFTCPMCSVSIFDMEKFLRALDAEIEAKFLHMGKGWIVCNHCWDTTRVYPGMTGQRKCCHCQSYNTCRVAPSVLPA

SEQ ID NO: 13790 - protein, 308 aa, Prochlorococcus marinus str. MIT 9313
MARKGIILAGGSGTRLNPITQAVSKQLLPVYDKPMIYYPLSTLMLAGIREVLIITTPQDQAAFDRLLGDGSQWGMSIQYAVQPSPDGLAQAFLIGADFLDGAPAALVLGDNLFHGHELVPQLQACNRQGSGATVFVYPVRDPERYGVAEFDASGRVLSLEEKPTQPKSRYAVTGLYFYDASVVAKAHQVQPSHRGELEITDVNRMYLEEGLLRVQQMGRGMAWLDTGTCDSLHDACSYIRTLEHRQGLKVGCPEEVAWRQGWINLQELEQLSMPLRKSGYGHYLMQLVEESVSDHGALQRTVEVADAG

SEQ ID NO: 13791 - protein, 489 aa, Vaucheria dichotoma
MSSKSVQERTRIKSQRYESGVIPYAKMGYWDAFYNVKETDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLVVERERMDKFGRPFLGATVKPKLGLSGKNYGRVVYEGLRGGLDFLKDDENINSQPFMRWRERFLYCMEGVNRAIAATGEVKGSYLNTTAGTMEEMYERANYAKSIGTIIVMIDLVIGYTAIQTMAIWARKADMILHLHRAGNSTYARQKNHGINFRVICKWMRMSGVDHIHAGTVVGKLEGDPLMVKGFYNTLLLTKLEIDLPQGLFFEMEWAALRKVVPVASGGIHCGQMHQLLYYLGDDVVLQFGGGTIGHPDGIQAGATANRVALEAMVLARNEGRDYLNEGPQILRDASKTCGPLKTALDLWKDITFEYTSTDTPDFIETPTQNN

SEQ ID NO: 13792 - protein, 410 aa, Porphyra yezoensis
MAFVGSTVTGVAGARAPTSKICSSRASFAQFSGMRSVNGARMLQPVQGADANDAFFAAVSTAAVPSASTAPTMKLKVAISGFGRIGRNFLRAWAAKSDTPLEVVCINDTSGVKTACHLLKYDSILGTFAGTVEAGEDSITINGKKVRVVSNRDPLQLPWAEMGVDIVIESTGVFVDKKGASKHLTAGAKKVLITAPGKGEGIQTYVVGVNDQDYTHATDDIVSNASCTTMCMAPFVKVLEDEFGIVKGTMTTTHSYTGDQRLLDAGHRDLRRARSAALNIVPTTTGAAQAVALVIPSMKGKLNGYALRVPTPNVSVCDVVVEVKRPTFKEEVNGAFLKAAQGPMKGILKYSDEPLVSSDFKGMVESTAVDVSMTTVVGDTMVKVLAWYDNEWSYSLRVLDLAEIMANKWE

SEQ ID NO: 13793 - protein, 141 aa, Glycine max
MQKMLSLLSRVLKGKAQKPVTAVRVMVASRNYADFASEATFDVKKCDVHRLEEGPPTQAVLTREQGLQYYRTMQTIRRMELKSDQLYKQKIIRGFCHLYDGQEACCVGLESGINPTDHLITAYRAHGYTYTRGVSVKEILT

SEQ ID NO: 13794 - protein, 390 aa, Oryza sativa
MAFAASHTASPYSCGGVAQRRSNGMSKMVAMASTINRVKTAKKPYTPPREVHLQVKHSLPPQKREIFDSLQPWAKENLLNLLKPVEKSWQPQDFLPDPSSDGFYDEVKELRERAKEIPDDYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFISHGNTARHAKEYGDLKLAQICGTIAADEKRHETAYTKIVEKLFEIDPDYTVLAFADMMRNKISMTAHLMYDGKDDNLFEHLSAVAQRLGVYTVRDYADMLEFLVQRWKVADLTGLSGEGRRAQDFVCTLAPRIRRLDERAQARAKQAPVIPFSWVYDRKVQL

SEQ ID NO: 13795 - protein, 252 aa, Lactobacillus delbrueckii subsp. bulgaricus
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLETREAGKENEWVVSQIKAGLEGLTSEQVSKLVIAYEPIWAIGTGKTASSDQAEEMCKTIRETVKDLYNEETAENVRIQYGGSVKPANVKELMAKPNIDGGLVGGASLVPDSYLALVNYQD

SEQ ID NO: 13796 - protein, 427 aa, Sirodotia suecica
IEASAAIAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERFLFSMEGVNRAQAAAGEIKGHYLNVTAGTMEEMYERAEFAKELGSIICMIDLVIGYTAIQSMALWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 13797 - protein, 310 aa, Shigella flexneri 2a str. 301
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENAEQRWQRILHIQQQLAGEQVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 13798 - protein, 662 aa, Neurospora crassa
MVLFKRPPDEKGSVWFSVLIGVFVAFGGLLFGYDTGTISGVIAMKYWNERFSTGYIDADGRPAISPSQSSLIVSILSAGTFFGALASPLLADKIGRRWGIIISSWVFNFGVSMQVISVAIPLFVAGRFFAGLGVGLLSALVPLYQSETAPKWIRGMIVGVYQLAITIGILFAAIVNNGTHEREDTGSYRIPIALQWLFSLTLIIGMHFLPETPRYCIKRGDMTRATRALARIRCLSPNDPAILAEMEEIRANYQYELSLGNSSYLDCFRKGMLKRMLTGMVLQILQQLTGVNFIFYYGTQFFENSGISNSFLISMILATVNVLSTVPAVFMFDKFGRRPLLLWGGVAMHICHFIVATLGTSTTSQTATGVIIVLNVAAQKASITFVCLFIAFFAATWGPLAWVVTAELYPLKHRSQMLSISTATNKHVPSFSTPDSVYYHDILGWLVNWAIAYSTPYLVNYGPGYANLQSKIFFVWGTACMLCVGFVYFYIYETKGLSLEEIDEMYQTPNLKAKDSSKWRPSVHFRETPLTEITYHKATGGSPAQAEAAPVAETAERAEREAVPTLPNLTTAPKIGPPPPPPESDDVLKTLQDAVLRPAGAFAHPATLNPAWNSHSPLSAQIAPSNLPSSSLASNRSAPSLGTTPNEGGTSSPHPARRSFGR

SEQ ID NO: 13799 - protein, 753 aa, Oryza sativa
MEKDHQPVISLRPGGGGGGPRPGRLFSPAFAAAASGSGDLLRSHVGGASKIGDPNFEVRERVRYTRDQLLELREIVDIPEAILRINQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAMKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIAPAVVPVTDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSGFVGRRGGGRVCWSRAASAAGALFARNMNLGWFAAAFTAFRCALNIVPGKNNISFGHPGKDIVPFVLSV

SEQ ID NO: 13800 - protein, 165 aa, Triticum aestivum
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCE

SEQ ID NO: 13801 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 13802 - protein, 135 aa, SYNECHOCOCCUS SP. WH 8102
MVKTPEAPASLTVAIDALDERLSQRFIALDPSGYFLIKVDADAGELVLEHYGNTIDEKGLARDSDTGEVLSCKGGNGLRQPSRIYRGSSAKQVGIQLTEGDGPHPLSRLDHALYLGRELQKAEQCLLNGSAYVQD

SEQ ID NO: 13803 - protein, 394 aa, Capsicum annuum
MDGPAQQTDTVMAEAAAAQQPAPPSQPVAGIDNIPATLSHGGRFIQYNIFGNVFEVTAKYKPPIMPIGKGAYGIVCSALNSETNEHVATKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPRNLLLNANCDLKICDFGLARVTSETDFMTEYVVTRWYRPPELLLNSSDYTAAIDVWSVGCIFMELMDRKPLFPGRDHVQQLRLLMELIGTPSEAEMEFLNENAKRYIRQLPLYRRQSFVEKFPHVNPAAIDLVEKMLTFDPRRRLTVEDALAHPYLTSLHDISDEPVCTTPFSFDFEQHALTEEQMKELIYREGLAFNPEYQHM

SEQ ID NO: 13804 - protein, 224 aa, Prunus persica
MTVEMHAGLASEGGSKLKMLISYVDNLPTGDEQGLFYALDLGGTNFRVIRVQLGGKEKRVVKQEFDEVSIPPNLMTGTSEALFDFIAEALAKFVATEGEGFHPAPGRQRELGFTFSFPVWQTSIASGTLIRWTKGFNIEDAVEQDVVGELTKSVEKIGLDMRVTALVNDTIGTLAGGRYHNQDVIAAVILGTGTNAAYVERAHAIPKWHGLLPKSGEMVINMEW

SEQ ID NO: 13805 - protein, 240 aa, Zea mays
GPGNYHCKSKARKIVAHLRRIGVFSESELRLQFLRCREAWLSGILEDLDQRNVYDYLKGMVTCHRVHLFDVVNQYRAIFNNDKSGNDENYDGGLLFSWAMQQVSNHLTTLQVMLPNITEGGSLSNILEQCMYCAMGLGLVGLDFRGLLPPIFENAVLNLFSKNMSTAVENFQVILDSHCWVPMPSVGFVANGVVDETSDDVTPPSVLMEHPPLAVFVNGKFYCVTCSILLLSLYSSISCG

SEQ ID NO: 13806 - protein, 503 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 13807 - protein, 490 aa, Emericella nidulans
MRSPLFLSFAATVLAATPAEWRSQSIYFLLTDRFARTDNSTTAECDTSAKYCGGTWQGIINQLDYIQGMGFTAIWITPVTANLEDGQHGEAYHGYWQQDIYALNPHFGTQDDLRALSDALHDRGMYLMVDVVANHFGYDAPAASVDYSAFNPFNSADYFHTPCDITDYDNQTQVEDCWLYTDAVSLPDVDTTNEEVKEIWYDWVGDLVSDYSIDGLRIDTARHVQKDFWRDYNDAAGVYCVGEVFQGDPDYTCGYQEVMDGVLNYPIYYPLLRAFSSTSGSLSDLANMIETVKYTCSDATLLGNFIENHDNPRFASYTDDISLAKNVAAFVILSDGIPIIYAGQEQHYSGAGDPANREATWLSGYDSTSELYQFISKTNQIRNHAIWQNETYLSYKNYAIYNENNVLAMRKGFDGSQIITILTNAGADAGSSTVSVPNTGFTAGAAVTEIYTCEDITVSGSGEVSVPMESGLPRVLYPKAKLEGSGICGL

SEQ ID NO: 13808 - protein, 434 aa, Vibrio parahaemolyticus RIMD 2210633
MKFPGQRKSKHYFPVHARDPLVSQAQESKKMTRTHIIGIDQTLVDIEAKVTSDVIEKYGLSKGHSLVIDDVKAEELYQQLKEENLITNEYAGGTIGNTLHNYSVLADDRSTLLGVMSQDIKIGSYGYRYLCNTSSRMDLNYLQGVDGAIGRCFALITEDGERTFAISEGQMNQLHPDSIPEKIFKNASALVLTSYLVRCKEGDPMPEATMKAIEFAKKNDVPVVLTLGTKFVIQDDPKYWQDFIREHVSVVAMNEDEAEALTGETDPLAASDKTLEWADMVLCTAGPVGLFMAGYTEDSAKRETTLPLLPGSIAEFNRYEFSRPAKKDACQNPIRVYSHISPYMGGPEKIKNTNGAGDAALSAVLHDMAANKYHKENVPNSSKHSNEYLTYSSFSQVCKYANRASYEVLVQHSPRLSRGLPEREDSLEEAYWER

SEQ ID NO: 13809 - protein, 145 aa, Shigella flexneri 2a str. 301
MPHRHVFNGMGYDGDNISPHLAWDDVPAGTKSFVVTCYDPDAPTGSGWWHWVVVNLPADTRVLPQGFGSGLVAMPDGVLQTRTDFGKTGYDGAAPPKGETHRYIFTVHALDVERIDVDEGASGAMVGFNVHFHSLASASITAMFS

SEQ ID NO: 13810 - protein, 71 aa, Glycine max
MLAQRENKSKNGKLRLLYECAPMSFIVEQAGGKGSDGHQRILDIQPTEIHQRVPLYIGSVEEVEKVEKYLA

SEQ ID NO: 13811 - protein, 486 aa, Agrobacterium tumefaciens str. C58
MMQGLKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETKTFHIGGLA

SEQ ID NO: 13812 - protein, 368 aa, Candida albicans
MATLKNKNNHLKACSTYTDNENHFLVDSRYEIVRVLGKGSYGVVCSAIDTKSSVSAMEHKIAIKKVTKIFNKDILLIRAIRELKFMMFFRGHKNLDVVYVKPYEGLYCFQELADLDLARVLYSNVQFSEFHIQSFMYQVLCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLGVEQILEPEFFKNLRNVHGEPSSKAIFDFSFEEKGKSIPQLKEILETEVRVFKEISKTGIE

SEQ ID NO: 13813 - protein, 339 aa, Chlorella kessleri
MLSSALYQQAGLSGLLRASAMGPQTPFIASPKETQADPMAFVKDLLAGGTAGAISKTAVAPIERVKLLLQTQDSNPMIKSGQVPRYTGIVNCFVRVSSEQGVASFWRGNLANVVRYFPTQAFNFAFKDTIKGLFPKYSPKTDFWRFFVVNLASGGLAGAGSLLIVYPLDFARTRLAADVGSGKSREFTGLVDCLSKVVKRGGPMALYQGFGVSVQGIIVYRGAYFGLYDTAKGVLFKDERTANFFAKWAVAQAVTAGAGVLSYPFDTVRRRLMMQSGGERQYNGTIDCWRKVAQQEGMKAFFKGAWSNVLRGAGGAFVLVLYDEIKKFINPNAVSSASE

SEQ ID NO: 13814 - protein, 607 aa, Nostoc punctiforme
MDDIFKGFEHLLEIAKALEEKVEKGELKTSIQIRSHNLSSIPRQGNIPRTSNSSRVRSNSTVGTTPMDDTDVTPPSARTNSKAAWQGIGGLADVLQEIRELVEIPLKRPDLLVKLGLEPPRGVLLVGPPGTGKTLTARVLAEELELNYIAINGPEVMSKYYGEAEARLRSIFEKATRSAPCLIFIDEIDSLAPDRSQVEGEVEKRLVAQLLGLMDGFAKTEGVLVLAATNRPDYLDPALRRPGRFDREVQFRVPDRDGRLEILTILTSAMPLETSVNLGAIADLAVGFVGADIKALCQKAAYIALRRQVPSLNSPVPENMTIVQQDFLEAIKEIKPSVLRDVAIEVPSVSWDDIGGLDDVKQKLQESVEGALLYPELYEQTKAKPPRGILLWGSPGTGKTLLAKAIASQARANFIAVNGPELLSRWVGAAEQAVRELFRKARQAAPCVVFIDEIDTLAPARGRFTGDSGVSDRVVGQLLTELDGLHECPKVLLVGATNRPEALDPALLRAGRLDLQIKIDLPDRASRLAILRVHNLDRPLVDVDLETWATVTEGWNGADLALLSNQAALSAIRRYRAQGLTDSSLIQITNDDFQVTYQMLANQHQSQ

SEQ ID NO: 13815 - protein, 419 aa, Sorghum bicolor
MEPVFSMEEILGPFWDLPSPPPPEQQPLVIGTSSVVIDGVVTHGGNGEGSNMMDQIQNTTEWTFERLLEEELLTDTTPVANSSCPALNVDPVVEVDQGAMAPEAVSAVGDPMEYNAILKRNVEEDLMAFKMWRASTSGVNSEGSNNENGGVSSSKNLVQTKLNGEDLINNHAQNADLHVRLTTSSSSRDPSPSDEDMDGEVEILGFKMPTEERVRKRKESNRESARRSRYRKAAHLKDLEDQVDKLKAENSCLLRRLAALNQKYNHATVDNRVLKADMETLRAKVKMGEDSLKRIIEMTSLTSIPIPELPSSSDVPVHIQDNIVNYFTTTPAGDALADNSFMPMPDPLPLQLQAEEPTINGALNATEMNQIATHCAAGSQPSMQLIQETMGAMMPTSSGSTLQESELLGPNETINMHMY

SEQ ID NO: 13816 - protein, 516 aa, Escherichia coli O157:H7 EDL933
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 13817 - protein, 557 aa, Methanosarcina mazei Goe1
MTNSLWMLGKTKRYLEVTRVLFKYNLIPELYHDLRTEYISNPDCTCTFDLENRETAAKLRQAFEELGPTFIKMGQTMSKRPDLVPQPYVVEMANLQDRVKPVPFEEMAESLDLACVCEYQTREERKRKKSEEELKAARERKAKAFIDIFDSFDPEPIACGSIAQVYKGVLEGKPVAVKILRPHLIDIINIDLSILDDFKPVMKKVMGVGKNFDIDAFLLEIREMLTREVDLRIEAVNMRRFEDNFKNVKNVSVPKIYPDYCSANVLTMEFIQGTQVKDIIDTPLPQSKKSEYTRTITKSYLKQVYIDGFYHADPHGGNMLVEENDTVSFIDFGAVGSIDDELKRNMLEFYYAINNRDVEGATQGFLKIGGADSRDVDVRRLRKDMDELIANQNYGLEGRQSDNYAKLGLKYDIRLPGEFSTLQRAILLIEGVCLELDPRYNIKSIAIPVLMDAYKKLNTPKGAALHIEFSSEPVDEKAEMRAAIREVADKMEGMGDRFLEVRQKDKRREVFSKEIFLAVLLVVSAYILLYGEVFYWVGLAGFGGAILIAVIASLKGK

SEQ ID NO: 13818 - protein, 271 aa, Triticum aestivum
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGDFDGHSKRVLSCDFKPTRPFRIVTCGEDFLANYYEGPPFKFKHSIRDHTNFVNCIRYSPDGTKFITVSSDKKGLIYDGKTGDKIGELSSEGSHTGSIYAVSWSPDSKQVLTVSADKTAKVWDISEDGKWNVE

SEQ ID NO: 13819 - protein, 392 aa, Escherichia coli
KITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGSKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 13820 - protein, 287 aa, Glycine max
MAPAMRIVFGLLTFVTVGMIIGALSQLAIIRRLEDSYGTDSLPFRRLRGLDTDRHLQLPRGVPFWNNDKEAEILRLGYVKPEVLNWSPRIILLHNFLSMEECDYLRALALPRLHISTVVDTKTGKGIKSDVRTSSGMFLNSKERKYPMVQAIEKRISVYSQIPIENGELMQVLRYEKNQYYKPHHDYFSDTFNLKRGGQRIATMLMYLSDNIEGGETYFPLAGSGECSCGGKLVKGLSVKPIKGNAVLFWSMGLDGQSDPNSVHGGCEVISGEKWSATKWLRQTTHT

SEQ ID NO: 13821 - protein, 386 aa, Escherichia coli
  unsure (1)..(386): unsure at all Xaa locations
TLHNGKLNVPENPIIPYIEGDGIGVDVTPAMLKVVDAAVEKAYKGERKISWMEIYTGEKSTQVYGQDVWLPAETLDLMREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEAXXXXXXXAIEYAIANARDSVTLVHKGNIIKFPEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAIXAKTVTYNFERLIKGD

SEQ ID NO: 13822 - protein, 901 aa, Zea mays; identical to SEQ ID NO: 6431

SEQ ID NO: 13823 - protein, 460 aa, Pseudomonas putida KT2440
MQSHGLKQSLKQRHITMIALGGVIGAGLFMGSGSLIASAGPAAILSYFIGGLVVTLVMFMLGEMACRNPDAGSFSTYANTYLGDWAGFAVGWLYWFKSMMTITLEAVLLGAILHDFLPWLPIWAGAFLMLVTLMASNAYSVRSFAEVEYWLAAMKVATILIFMLLGVSILLGLHSDIPAPGLINLTAHDGFMPNGLSPVMAGVIVVIFSLGGSEIAAVAAGESENPRQNVIRAIKSVILRVMLFYVGSVSILILCLPWTDKANLASPYVSLFSLAGFGGAAVAMKLVLFVSFMSVMNSFMFSNSRMLFSLSQRGHAPKLFSRTSAKGVPINALLLSLSICTMILTVHFVSGGDLFMTLAKSTGSLVMVVWIFIIIAHVAMRIKTRHEAVAPNAFRAWLFPYTNIIALFALLAVIGTQAFDPASRFQFWFTVLTVLLVVAGYFLMRQRLASSAVLAHERDA

SEQ ID NO: 13824 - protein, 418 aa, Glycine max
  unsure (1)..(418): unsure at all Xaa locations
TFSKVSLLLLVSLSFSYATSGFNHEHAYPPQSQAEMLTRNLNLFPKDPVNIIKGDFDSFVPGKIVEKKFSLLGHSGPSIQHLGHHAGHYSLPHSKAARMFYFFFESRNNKDDPVVIWLTGGPGCGSELALFYENGPFHIANNLSLTWNDYGWDQASNILFVDQPTGTGFSYSSDDSDIRHDEASISNDLYDFLQEFFKAHPKFVKNDFYITGESYAGHYIPALASRIIQGNKENQGIYINLKGLAIGNGATNPAIQYQAYPDFALDNKIITKANYDEINKLIPDCEQAAKTCETQGGQSCAIAFNTCQKIFYHILDFAPGINYYDIRKKXCKGDWCYDFRNVETLLNLPKVKSVIGVSNDLQYVSCSKRVHEAMMQDYMRNMEVEIPSLLEDGIKLLVYVGEEDLICNWLGEPTNSFN

SEQ ID NO: 13825 - protein, 305 aa, Kluyveromyces lactis
MSTDKKQSNFAIDFLMGGVSAAVSKTAAAPIERVKLLIQNQDEMIKQGSLDRRYTGIVECFKRTAADEGVASFWRGNTANVIRYFPTQALNFAFKDKIKAMFGFKKEEGYAKWFAGNLASGGLAGGLSLLFVYSLDYARTRLAADSKSAKKGGERQFNGLVDVYKKTLASDGVAGLYRGFLPSVVGIVVYRGLYFGLYDSLKPLLLTGSLENSFLASFLLGWAVTTGASTASYPLDTVRRRMMMTSGQAVKYDGAFDAFRKIVAAEGIKSLFKGCGANILRGVAGAGVISMYDQLQVILFGKTFK

SEQ ID NO: 13826 - protein, 121 aa, Triticum aestivum
  unsure (1)..(121): unsure at all Xaa locations
MHLRQQQQQQHRAEMVAPKGCVTVRVGADGEEQRRFAVPLDHLKHPLFGALLDEAEREYGFRHQGAIAIPCRVDRFVHVERLIXRDLGAHGHQLVDLDCGAATAHAHGHLHLPRFVGCFRA

SEQ ID NO: 13827 - protein, 201 aa, Raphanus sativus
LEEVKDSNGNPVRVGAQYFIQPVKTESNNGGGLVPAATNILPFCPLGITQTLLPYQPGLPVSFGYHPNILGRDTIDTSANINIEFRSPIWPVCNEFSKLWAVDSSSASNEPAVIIGGEPKSPNSAFKIEKAAGAHIYKLTTSSGTVGTTPGAWLSAPQLLVTNDVAKTLFVKFVKVDNDATTATTSTSRVEKLGLKMFPFY

SEQ ID NO: 13828 - protein, 439 aa, Brassica rapa
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 13829 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGVKNKMDPGEAMDINLFKLTLDEIREKGIKQMPHTLRRSLEEMLADKQYLKEGQ

SEQ ID NO: 13830 - protein, 403 aa, Glycine max
MASDGFTDKNTVFRKLKAKSENKMCFDCNAKNPTWASVTYGIFLCIDCSAVHRSLGVHISFVRSTNLDSWSPEQLKTMSFGGNNRAHGFFKQHGWTDGGKIEAKYTSRAADLYRQILSKEVAKSMAEDGGLPSSPVASQSAQGVNGLPEVKTNEVPKENTLEKPEKPESTSSPRASHSVISGTVKKPIGAKKAVKSGGLGARKLTKKPSESLYEQKPEEPPAPVSSSTNNMPAGPSPTSRFEYVENVQSSELNTGGSHLLSHVSPPKSSSFFADFGMDGGFPKKSGPSSSKVQIQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 13831 - protein, 313 aa, Spirulina sp. PCC 6313
NGFGRIGRNFLRCWAGRTDTNIELVGLNDTSDPRTNAHLLKYDSMLGKFAGDVSADDTTITVNGKTIKTVSDRNPDNLPWKDWGIDLVIESTGVFIDKVGASRHINAGAKKVLITAPGKNEDGTFVVGVNEDQYNHDIHNIISNASCTTNCLAPVAKVLLENFGIVKGVMTTTHSYTGDQRLLDASHRDLRRARAAALSIVPTSTGATKAVALVLPELAGKLNGIALRVPSPNVSVVDFVVQVEKKAIAQEVNEAFRAAAEGPMKGILEYNELPLVSIDYRGTDASSIVDSSLTMVMGGNMVKVVAWYDNEWG

SEQ ID NO: 13832 - protein, 515 aa, Oryza sativa (japonica cultivar-group)
MSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLGAFWNVAENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNVDA

SEQ ID NO: 13833 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 13834 - protein, 518 aa, Schizosaccharomyces pombe
MRDFQSRFADRYNQITNSYSYSSSRQGLITGMVNVGSFFGCLLSSPVADKIGKRLSIIVWTTVYLIGIIIQVTTVPSWVQILVAKIWTGLSIGALSVITPGYQSEVAPAIMRGAIVTTYQLFITLGIFIAACINMGTHKYSHGTTAQWRISIGINLLWGIITLVGIIFLPESPRYLIAIGKDDEALKIMCYNNDLPLEHEIIQTEYHTIKSDCDAELAGGPARWPEIFNANIRYRTFLGMAVMMFQQLTGANYYFYYGTQVFRGTGMDSPYLAALIPDAVNCGCTFGAIFVLEFFGRRSPLIVGGIWQYICFFIYAAVGDRALYHKNGTSNHRAGAVMIVFSCLFIFSFSQTWAPAAYVIVGESYPVRYRSKCAAVATSANWFWNFLISFFTPFITNSIGFKYGYIFASCNLTGAAIIFLFVHETKGRTLEEINTMYASNLKPWMPHPEGYREFGREQNNATLKSHIGLNGETTELIENTDNQGDSGSFQTSTPDDSRPEQNQASATYIRPDKREPRL

SEQ ID NO: 13835 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRLSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPFIHYSDDNVLQTRIFSYADSQRHRLGPNYLQLPVNAPKCAHHNNHHDGFMNFMHRDEEVNYFPSRLDPVRHAEKYPTTPIVCSGNREKCFIRKENNFKQPGERYRSWDSDRQERFVKRFVEALWEPRVTHEIRSIWISYWSQADKSLGQKLATRLNVRPNF

SEQ ID NO: 13836 - protein, 229 aa, Chlamydophila pneumoniae J138
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYQGFTVQSFLPHTIEKIAFARHAIKTLGLKDSCLIEVDGGIDQQSAPLCRDAGADILVTASYLFEADSLAMEDKILLLRGENYGVK

SEQ ID NO: 13837 - protein, 128 aa, Zea mays
HSTLPGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 13838 - protein, 491 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDRFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 13839 - protein, 102 aa, Glycine max
  unsure (1)..(102): unsure at all Xaa locations
MGSENSFAEVTGNTTMDSAEKRLNELGYKQELRREMTMFKTLAISFSTMTLFTGITPLYGSSLQYAGPATLVXXWIVVSFFTWFVGIAMAEICSSFPVCLFS

SEQ ID NO: 13840 - protein, 510 aa, Sesamum indicum
MFIESFKVESPNVKYTEGEIHSVYNYETTELVHESRNGTYQWIVKPKTVKYEFKTDTHVPKLGVMLVGWGGNNGSTLTGGVIANREGISWATKDKVQQANYFGSLTQASSIRVGSFNGEEIYAPFKSLLPMVNPDDVVFGGWDISNMNLADAMGRAKVLDIDLQKQLRPYMEHMVPLPGIYDPDFIAANQGSRANNVIKGTKKEQVQQIIKDMRDFKEQNKVDKVVVLWTANTERYSNVVVGLNDTAESLMASVERNEAEISPSTLYAIACVFENVPFINGSPQNTFVPGLIDLAIQRNSLIGGDDFKSGQTKMKSVLVDFLVGAGIKPTSIVSYNHLGNNDGMNLSAPQTFRSKEISKSNVVDDMVASNGILYEPGEHPDHIVVIKYVPYVGDSKRAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 13841 - protein, 197 aa, Carboxydothermus hydrogenoformans
RLVNAGITDIGVIIAPETGEEIKKSITNAGFPAKFTFILQEKPLGLAHAVKVAKDYLEDDDFIMYLGDNLINSGIKEFVEEYKENRYDATILLKEVQDPTRFGVAVVDENFKVQRLIEKPKEPPSNLALVGIYIFSPKIFSAIDRIKPSWRGELEITDAIQELITSGGMVQAHKITGWWLDTGKKDHLLGSQPGCIR

SEQ ID NO: 13842 - protein, 506 aa, Brucella melitensis 16M
MVMSTIVKPQPLTGLEVREFSMLIDGKWVGSDSGKSIERVAPGHGVTVSRYPAGNKANVERAVSAARKAFDDGRWSSKTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 13843 - protein, 725 aa, Neurospora crassa
MSSSTTPAALKAAILIVSTTAAQDPATDSADVTLRQVFDEQQAQWEVHESKIVPDDVVQIQKQIIHWTNQATAASGDNNNNNNTNTINLIVTTGGTGFAVSDQTTEAVSALLHKNAPGLVHGMLAASLQVTPFAMMSRPVAGVRNGTVIVALPGSPKGAKENLQAVIKMLPHACMQAAGANSRALHKGGVKKLEQEAGVEGGGGRGHGHGHGHGHGHKHHDHGEHRGGGGGGCGAHGHGHNHGHGPGHGHAGLVRHTIPSENPKSNDPSLGPSRRHRESPYPMLSVSEALSQIAQHTPMPQIVTSKVDSSLIGAVLAQDVSARENVPAFRASIVDGYAVVVPQDGNMRGVFPVVSVSHAAPGDGEKMPTLKEGEIARITTGAPLPPGATSVIMVEDTVLVSTTSSKTEDAEDGKGVEEEKEVEILAADKVREGENVREVGSDIKQGQLILGKGDQVSAVGGEIGLLAAVGVGEVQVYRRPVVGVLSTGDEIVDHDRPGDLRLGEVRDTNRPTLISAARDWGYEVIDLGVARDKAGTLEETLRQALRQVDVVITTGGVSMGELDLLKPTIERSLGGTIRFGRVAMKPGKPTTFATVPVKDNDGERVSKVIFSLPGNPASALVTFHLFVLPSLHQMSGVSPPGLPKVPVTLGHDFSLDRSRPEYHRAIVSVSRDGVLTAVSTGGQRSSRVGSMKGANALLCMPCGPEPLRKGAKVEALLMGGLRSDV

SEQ ID NO: 13844 - protein, 229 aa, Oryza sativa (japonica cultivar-group); identical to SEQ ID NO: 10862

SEQ ID NO: 13845 - protein, 354 aa, Oryza sativa
  unsure (1)..(354): unsure at all Xaa locations
MAFMSMERSTWAFTFGILGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRXVIRTKSVXEFMPFSLSFFLVLSAVIWFLYGLLKKDVFVALPNVLGFVFGVAQMALYMAYRSKKPLVASSSSAVVAAGLEIKLPEHVKEVQAVAKGAVAAAPEGRISCGAEVHPIDDVMPSEVVEVKVDDEETNRTDEMAGDGDHAMVRTEQIIKPDMAIVVETGIRTKGETGRHVERPRLQAAVDDTTERERRLNGC

SEQ ID NO: 13846 - protein, 313 aa, Nitrosomonas europaea ATCC 19718
MSIDSYSTLTKRNVILFGEALADIFPDGPVMGGAPLNVSCHLQAFGLHPMLITRTGTDELHRKLIRLMRNAGMTISGIQSDPHYPTGQVLIKPGENWYGHQFEILENQAYDFIDPVTAATAASSIEPDLVYFGTLAQRSRLSGSALETIFRYTPQTPRLLDINLRKPWYTRDTVRYSLTRADHVKVNEDELIELPGLLNLHTRDPRDTASRLIEEFQLHTLLVTCGAEGAWLLDQSGNEAETPGITDITVIDTVGAGDGFSAVFILGMLLGWPETLTLERANRFAAALCGIRGAIPESSEFYSPFLKDWGMIN

SEQ ID NO: 13847 - protein, 362 aa, GIBBERELLA ZEAE PH-1
MANHPPPPQKMKALRLLEYNKGYKLCDDAPVPIPKPDEVLVRVATAGFCHSDLMVHHGLTQVPLPFIGSHEPAGTIVNRGSDVPEGWHVGDRVGVTNFMDPCDNCKGCKWATQTIGSLDPRFCDNRTMCGILRRDGAFAEYMTSWHGALVHLPDSMSFEQAAPLMCAGATVWHAINQADVQAGQTVAIVGIGGLGVLGIQFAKARGYRVAAIDNHETGLRLATEVPSHLKPDLILKYDDPETIRKISDFTDEIGLKAAVICNSDDDANDWAAHQLQPRGVLVAAGFPDNGLRFDPMNLVLREIVVKGIVHCSMEETREMMKFVTDHGIRSRLSLLTMEEAEDIIAKTQAHTLIGRPVVMIEG

SEQ ID NO: 13848 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 13849 - protein, 214 aa, Thermoanaerobacter tengcongensis
MKISASILAADTAFLGKEVLELEKLGIDFIHVDVIDGHYANNFGFSPKTVKDLRRITDLPIEVHLEILNPENYVEIFSEAGADIIIVQFDTCSHPLRILRKIKALGKKAGVALSPCVSFESLRWCLNDVDYLLFMSVEPGFGGQNFETFTIDKIKLAKVQLKEMGFSIPIGVDGGVNLGNINLLREVGVDIVVVGSALFLNENKERFIFQVKGG

SEQ ID NO: 13850 - protein, 115 aa, Triticum aestivum
QGLKSTACLPVSRRSNGASLGSVSNGGRIRCMHVWPIEGIKKYETLSYLPPVSTEALLKAVDYLIRSKWEHSLEISRVGFILREHNASSGYYDGRYWTMWKLTMLGCTDATQVIN

SEQ ID NO: 13851 - protein, 762 aa, Caulobacter crescentus CB15
MTTAAQPSSALRILCRTTAAVALLAFLPMSGAMAQVMPTKDSAPLTARPGDPAWVRADALVKQMTLDEKITYLHGLFPPMAKPAPTDMIPSAGYVPGVPRLNIPTLRESDASLGVANQVEQRKGDVATALPSGLALASTFEPKLAFDGGAMIGAEARAKTFNVLLAGGVNLTRDPWAGRNFEYLGEDPLLAGEMVAEQIKGVQSNKIVSTIKHFALNAQETGRHVMDAQIDEADLRESDLLAFQIAIEKSNPASVMCAYNKVNGDWACENDFLLNKVLKRDWNYPGWVMSDWGAVHSTVKAALAGLDQQSGQELDTQIFFGEDLKAAVAKGEVSQARVDDMVRRILHGVISSGLMDNPTPTSAQPIDYDAHAKVAQTVAERGSVLLKNDRGLLPLAKSAKKIVLIGAHADVGVISGGGSSQVRSVGGAPVEIPLKGGEAASFVRVTWHASSPLQAIKAANPSAEVTYVDGKDPVAAAAAAKDADVAIVFAWHWQTEAQDAPSIALPENQDALIEAVSAANKNAVVVLETGGPVLMPWLDKVGAVLQAWYPGQRGGQAIARLLFGEVNPSGRLAMTFPKSEDQAPRASAPGFAEQAAIDDARRAGQKAGPIKGFPVRYVEGAAVGYRWFAQEKRRPLYPFGYGLSYTSFGYKNLKVEDGDGLKVSFDVTNTGKVAGADTPQLYVTSGQRKAMLRLAGFQKVDLAPGETKRVTLNVEPRILADYDTAKPGWTIAAGTYPLYVGRNAGEPVLTGSAKLKSWSRKP

SEQ ID NO: 13852 - protein, 277 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLLQELKLACKNIYAEDLFIRMERHILDTLDWDISIPTPASYIPVLDPIFFLVLDASMFVPNLFKFPASKIACSVMNIVNEHVGS

SEQ ID NO: 13853 - protein, 107 aa, Tulipa gesneriana
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 13854 - protein, 815 aa, Yersinia pestis CO92
MTSPFSYTSPVVSVDALKHSIAYKLMFIIGKDPTIATQHDWLNATLFAVRDRMVERWLRSNRAQLSQDVRQVYYLSMEFLLGRTLSNALLSMGIYDEIEQALDEMGLSLSELLKEENDPGLGNGGLGRLAACFLDSLATLALPGRGYGIRYEYGMFSQKIVNGQQMESPDNWLEYGNAWEFPRHNTRYKVRFGGRIQQEGSKIRWLETEEILACAYDQIIPGFDTDATNTLRLWSAQASNEINLGKFNQGDYFAAVEDKNHSENVSRVLYPDDSTYSGRELRLRQEYFLVSATVQDILNRHWAMHHTFNNLADKIAIHLNDTHPVLSIPEMMRLLIDEHKFTWMDAWDVVQQVFSYTNHTLMSEALETWPVDMIGKILPRHLQIIFDINDHFLKLVEEQYPDDKELLSRVSVIDENNGRRIRMAWLAVIASHKVNGVSALHSELMVQSLFADFARIFPNRFCNKTNGVTPRRWLGLANRPLAAVLDDSIGQTWRTDLSQLSELEKNLDYPSFLLALQKAKLENKKRLAVYIAEKLNIVVNPAALFDVQIKRIHEYKRQLLNVLHVITRYNRIIDAPDNNWVPRVVIFAGKAASAYYNAKQIIHLINDVAKVINNDPRINNLLKVVFIPNYSVSLAQLIIPAADLSEQISLAGTEASGTSNMKFALNGALTIGTLDGANVEIREHVGEENIFIFGNTTEQVEALRKSGYNPRKYYDEDPELHQVLTQIATGTFSPEEPHRYTNLFDSLVNLGDHYQLLADYRSYVDTQEQVDALYRNRDEWSRKTLLNIANMGYFSSDRTIKEYADEIWHIKPIRL

SEQ ID NO: 13855 - protein, 99 aa, Pseudomonas aeruginosa
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQV

SEQ ID NO: 13856 - protein, 514 aa, Escherichia coli CFT073
MKIRSQVGMVLNLDKCIGCHTCSVTCKNVWTGREGMEYAWFNNVETKPGIGYPKNWEDQDEWQGGWVRDVNGKIRPRLGSKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIEAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 13857 - protein, 301 aa, Triticum aestivum
MGILSLITGKPGASGFGSGSTAEQVTEGISAAGLTVLVTGGSSGIGLETSRVFALRGAHVIIAARNTEAASEARKRIMEIHPVARVDVLKLDLSSLKSVRAFADQFNSMNLPLNILINNAGVMFCPFQLSEDEVEMQFATNHLGHFLLTNLLLDNMKTTAKSTGIEGRIVNLSSVAHLHTYPKGILFDQLNDKKIYNDKMAYGQSKLANILHAKELSRRLKEEGANITVNCVHPGLIMTNLMRHSFALMKAIQVVTYLFWKNVPQGAATTCYVGLNPQLKGVTGKYFADCNEEKTSKHAKS

SEQ ID NO: 13858 - protein, 183 aa, Escherichia coli K12
MKTLIVSTVLAFITFSAQAAAFQVTSNEIKTGEQLTTSHVFSGFGCEGGNTSPSLTWSGVPEGTKSFAVTVYDPDAPTGSGWWHWTVVNIPATVTYLPVDAGRRDGTKLPTGAVQGRNDFGYAGFGGACPPKGDKPHHYQFKVWALKTEKIPVDSNSSGALVGYMLNANKIATAEITPVYEIK

SEQ ID NO: 13859 - protein, 137 aa, Zea mays
  unsure (1)..(137): unsure at all Xaa locations
MTNLCQTTVEIVQRVPTVGDDLIGTNLFMVSNSVYETTXPALVLXVNQIGSVTESVEADNMDKRSGWXVMAGHRXSXTHDTFIADLSGGLSTVHITMGAAXRSERMAKYNLLLRIXEELGDASVYAGAKFRSPVQPY

SEQ ID NO: 13860 - protein, 408 aa, Geobacter metallireducens
MPMDQLSMATGLKNSTDVLFLMLGAVMVFAMHAGFAFLEVGTVRKKNQVNAFVKILTDWSVSTIAYFMVGFPIAYGISFLVPAGDLMGATQGYDLVHYFFLLCFSACIPAIISGGIAERAKFWPQVFAGALFAALTYPIFESLIWGKNASILQGFFKSIGGAEFHDYAGSVVVHSMGGWLALPAVLTLGPRMGRYIRSKSHPIPISNIPFLALGSWILAVGWFGFNVMSAGHLDKISGLVAVNSLLAMVGGVLAALLAGKNDPGFIHNGALAGLIAVCAGSDIIHPLGAFATGAIASVIFVYGFQIEQERLKIDDVLGVWPLHGIIGSWGGIAAGIFGQPLLGGIGGISFISQLLGTVAAILFALANGFLVYTVLSKTVGIRLSDEEEFAGADLSIHKIGAYPEDHVR

SEQ ID NO: 13861 - protein, 57 aa, Glycine max
GTFHSFHPVVTILSYLPKVPLVPPGAPVVYALSKQRAILINIIRACAALAPKNHMIL

SEQ ID NO: 13862 - protein, 540 aa, GIBBERELLA ZEAE PH-1
MNTLRRASLSKPEEAGKTWPAIAIGAFVAFGGVLYGYDTGTISGILAMPYWQSLFSTGYRDAKGHLNITTAQESGIVSILSAGTFFGALSSPFMTDYIGRRPGLMIATWVFNLGVCLQVAATSIPLFLAGRFFAGFGVGQISAIIPLYQSETAPKWIRGAIVGSYQWAITIGLLLAAIVNNATGGRNDTGSYRIPVAVQFAYSLILFGGMIILPETPRFLIKKDRHEAAAKALSRIRRLTPDHPAIQAELAEVRANHEYETSIGKSSYLDCFKPPILKRQFTGCALQALQQLTGINFIFYYGTKYFQNSGISSGFVISMITSAINVASTIPGMYAIDKWGRRPLLLWGAVGMCVSQFIVAMAGTFSTGQNADGTIFVKSLAGQKAAVSFVCIYIFFFASTWGPLAWVVTGEIFPLKTRAKSLSMTTATNWLFNWAIAYSTPYLVDYGSGKANLQSKIFFIWFGCCFLCIAFVYFFIYETKGLSLEEVDQLYDEVSVASKSKQWKPSESWEHRQSVSGADGKMFGGNDHQGEVTHNEKNEA

SEQ ID NO: 13863 - protein, 368 aa, Halobacterium sp. NRC-1
MRDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 13864 - protein, 225 aa, Triticum aestivum
  unsure (1)..(225): unsure at all Xaa locations
IVGAQVPLGAGVAFSQKYLNNPSVTFALYGDGASNQGQVFEAFNMAKLWDLPCVFVCENNKYGMGTSDKRSSASTEYLERGDYIPGIKVYGMDVLSVYRACQYAKEWTTTGKGPLVMEISTHRXYGGHSMSDPGTTYRTREEIQHMRSTSDPINGLKQRLIDIGMATEADLKAIDKECRKIVDEALKKAEAAPEPPLSEFHTQIYQPGTEPPVVRGREPNEVYHY

SEQ ID NO: 13865 - protein, 293 aa, Zea mays
MDAPFFHELRRQASSYLTGKIRSARLALTDVTPTQLLTEEATNGDASPPNVRTMGRIARQAFDVDEYVRITGVLHGRLASFDRRQWREAYKALLLLEHLLTHGPRSVAVEFHKDREAIDRMATFQHVDEKGFNWGLTVRSKSERVLKLLERGPFLEEERERARKIAREITGFGSFSLSAGASHHAVSQSQPPGDDGNRGDGRSSSKREERQRHDDGGRFGRSHSQFEERWWKHKDGDDGDKENLIQSPEPTARVAPREVDAEAEEEELHHHQLHPFHGLGQKQRPEATLLLSQ

SEQ ID NO: 13866 - protein, 101 aa, Triticum aestivum
MAEAALEGSEPVDLTKHPSGIIPTLQNIVSTVNLDCKLDLKAIALQARNAEYNPKRFAAVIMRIREPKTTALIFASGKMVCTGAKSEQQSKLAARKYARII

SEQ ID NO: 13867 - protein, 326 aa, Wolbachia endosymbiont of Drosophila melanogaster
MKAENFTKEQIIGFYRKMLLIRRFEEKAGQLYGMGLIGGFCHLSIGQEAVAVGTQAASKLGDAFITSYRDHGLMLACDSDPNVVMAELTGKETGCSKGKGGSMHVFDVEKKFFGGHGIVGAQVPIGTGIAFANKYKKKDNVVFTYFGDGAANQGQVYESFNMASLWELPVVYIIENNEYAMGTSVQRSTLVTELYKRGESFGIPGKQVDGMDFFSVYEATSEAAEHTRSGKGPILLEMKTYRYRGHSMSDPATYRLKEEVEDMKQNHDPISTLKKYMTDNKMASEEECKVIDKEIRDLVKKSEDFAKNSKEPSVDELYTDVYKFVS

SEQ ID NO: 13868 - protein, 652 aa, Brassica napus
MAAATSSSPISLTAKPSSKSPLPISRFSLPFSLTPQKPSSRLHRPLAISAVLNSPVNVAPEKTDKIKTFISRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQVLDELTQGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 13869 - protein, 905 aa, Neurospora crassa
MASNTTQRVPLRERRPSVGAPLVDIQGGVAPAGVSRPKHKRTLTGFGPGEIKNVEASIPEPQRKAWLAHQTSGFKDKDGFETEVVRHVETTLARSMYNCDEQAAYSACSLAFRDRLILEWNRTQQRQTFADSKRVYYLSLEFLMGRALDNAMLNIGQKDVAKAGLAELGFRIEDVIEQEHDAALGNGGLGRLAACFLDSLASLNYSAWGYGLRYRYGIFKQEIIDGYQVEVPDYWLDFNPWEFPRHDVTVDIQFYGHVTKRTDDNGKTIATWEGGEIVKAVAYDVPIPGYATPSTNNLRLWSSKAASGEFDFQKFNSGDYENSVADQQRAETISAVLYPNDNLDRGKELRLKQQYFWVAASLYDIVRRFKKSRRPWKEFPDQVAIQLNDTHPTLAVVELQRILVDLEGLDWEEAWNIVTNTFGYTNHTVLPEALEKWSVPLFQHLLPRHLQLIYDINLFFLQSVERKFPKDREMLARVSIIEESQPKMVRMAHLAIVGSHKVNGVAELHSDLIKTTIFKDFVEVFGPDKFTNVTNGITPRRWLHQANPRLSELISSKTGSQNFLKDLTELAKIEHYKDDKAFRKEWAEIKYANKVRLAKHIKKTTGVDVNPSALFDVQVKRIHEYKRQQMNIFGVIHRYLTLKSLSPEERKKFQPRVSIFGGKAAPGYWMAKQIIHLINAVGAVVNNDKDIGDLLKVIFLEDYNVSKAEMIIPASDLSEHISTAGTEASGTSNMKFVLNGGLIIGTCDGANVSNNPLFYAMSSLANPLQIEITREIGEQNIFLFGNLAEDVEDIRHNHTYGSYTVDPDLVKVFEAIEKGTFGEPNDFMGMISAVRDHGDFYLVSDDFHSYIETQELVDKAYRDQEGWITKSIESVARMGFFSSDRCINEYAEGIWNIEPLAVKDQ

SEQ ID NO: 13870 - protein, 169 aa, Glycine max
MATFPTLHGLHNPLPRSQFLGQDHPLLTHHFPLKQQVHHHKTAPTHEVLKPHAKFNILEMMGGRGLCNGEKGIQQELKKQVVVQDQPSLSSQEEASSGNKEEQEDEGSVEVPEDGFEKEMMGLTGGFPGGEKGLKKFIEKSNPPTTKATNNVAPSRFERGHCEEYSKEK

SEQ ID NO: 13871 - protein, 475 aa, Gelidium microdonticum
QRYESGVIPYAKMGYWDPDYAIKETDVLALFRVTPQPGVDPVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPLMIKGFYNTLLLSHLKVDLPQGIFFEQDWASLRKVTPVASGGIHCGQMHQLLDYLGDDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 13872 - protein, 468 aa, Vibrio alginolyticus
MSVEKVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEESAEIPTVAYSLKDALAELDADREFLTAGGVFSDDFIDSYIELKSQDVERVNMTTHPVEFELYYSV

SEQ ID NO: 13873 - protein, 484 aa, Rhodospirillum rubrum
MTTRLTTTAGAPVADNQNSLTAGPRGPVLLQDYQLIEKLAHQNRERIPERVVHAKGWGAHGTLTITHDISRYTRAKLFSAVGKTTPVLARFSTVAGELGAADAERDVRGFSLKFYTEEGNWDLAGNNTPVFFVRDPLKFPDFIHTQKRHPRTHLRSPTAMWDFWSLSPESLHQVTILMSDRGLPLDPMHMNGYGSHTYSFWNDAGERFWVKFHFKTQQGHAHLTNAAAKVVVGESRESYQEALFGTIESGHFPRWTLFVQIMAEREAETTPYNPFDLTKVWPHGDFPLIEVGVLELNRNAENYFAEIEQAAFSPSNVVPGIGHSPDKMLQARVFAYADAHRYRLGTHYEALPVNAPLSPVNHYHKDGPMRFFPNNPNADAYYEPNSFGGPKEDPSVKEPPLRINGDADHYNHREGNDDYVQVGALFALFDEGERQRLFSNIAEAMAGVPEEIIRRQLVHFHRADPAYGEGVAKALGLAPVSQPA

SEQ ID NO: 13874 - protein, 182 aa, Pseudomonas syringae pv. syringae B728a
MTFDQSNFKSLIRPVVDFPKPGVVFRDITPLFQSPKATRQVIDSFVQRYIDAEFSHIGVMDARGFLIGSVVAYQLNKPLVLFRKQGKLPADVLSEAYQTEYGEAYLEVHADSLCEGDSVVMFDDLIATGGTLIAAANLIRRMGAEVYEAAAIIDLPELGGSKRLNDLKIPTFCLTEFALDEQ

SEQ ID NO: 13875 - protein, 58 aa, Hordeum marinum
KGKLPKEARQKLLHWWELHSKSPYPSETEKMALGESTGLDQKQINNWFINQRKRHCKP

SEQ ID NO: 13876 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGGSHSSIFDASAGIQLSPKFVKLVSWYDNEYGYSTRVVDLVEHVAKA

SEQ ID NO: 13877 - protein, 572 aa, Oryza sativa
MRGATGPTCQPHALNKYSPRSTRAAAFATLIRKHQQLNPALASDSPMAAAIIGGGGWTRLRSVGRGASGAVVSLAANDVSGELFVIKSAGEGAARQQLRREWSVMSGLSSPHVLKCLGFVQASGGCGGGEHQLFLEYAPGGSLADVVARNGGRLDEGAVRTYAADVLRGLDYLHGKLVVHGDVKGSNVLVGADGRAKLTDFGCARVAMPGGSKQPVLGGTPAFMAPEVARGEEQGLAADVWALGCTVIEMATGRAPWSDMDNVLPALHKIGYTDAVPDLPRWLSPEAKDFLRGCLQRRAGDRPTGAQLLQHPFISKSCGLNNKETVKATWVSPTSALDATLWESESSSTDGEEVDDMSSNSPTGRIRAMACSCQTLPDWDSDDHGCSWIEVLGSVSINVANKTAAIEQRVTSMACSPSSVPDWDSGNQGWIDVLSSVSISIANKLETATAADNVSSECPAKWVRAMACSPSSVPDWDSDQGWIDVLGASPDVVAAEEFDVAAAADQISGQAVGSIVVGVGSSEQSVVVENQEDEFTSLSSCSERVLLVGVHAADNNAASRKAGIKRCSNFSC

SEQ ID NO: 13878 - protein, 344 aa, Nitrobacter winogradskyi
IGCHTCSIACKNIWTDRKGTEYMYWNNVETKPGTGYPTRWEDQTKYRGGWVVDGQRQKSLRLRLQGKWGTLTNIFYNPYLPTPDDYFEPWTYDYQNLINAPLADEQPTARAISMVTGKYMDTIEAGPNWDDDLGGSQVYANNDPNFDGASDEEMRQINEINSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPAAKIQAAQQSPVYQFVKKWGIALPLHPEFRTLPMLFYVP

SEQ ID NO: 13879 - protein, 270 aa, Pleurotus djamor
AHFDRERDPERVVHAKAAGAHGYFEVTHELSDITSNPLLTSVGKKVDLTARFSTVGGESGSADTARDPRGFAFKLRTEQGNWDWVFNNTPIFFIRDPAKFPHFIHTQKRDPQTHLKDADMFWDYLGQNPESIHQMMILFSDRGTPDGVDSMHGYSGHTFKWLKNDGTFVYVQVHVRADQGFKTLDGPTAHKLTADNPDYSTEKMFNRIEKGDYPSWTVYIQTMTPEQAESFRYNILDLTKVWPHAQYPLRPIGKVVLNKNPVTYFAEVEQ

SEQ ID NO: 13880 - protein, 396 aa, Zea mays
MALRLNDVALCLSPPLAARRRRSRSRSSGRFVAVASMTSAVSTKVENKKPFAPPREVHVQVTHSMPPHKIEIFKSLDDWARDNILTHLKPVEKCWQPQDFLPDPASEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMRKKISMPAHLMFDGQDDKLFEHFSMVAQRLGVYTARDYADILEFLVDRWKVVNLTGLSGEGNKAQDYLCTLASRIRRLEERAQSRAKKAGTLPFSWVYGRDVQL

SEQ ID NO: 13881 - protein, 605 aa, Fragaria x ananassa
MDTKIGSIDVCKTENHDVGCLPNSTTSTVQDSVPSTCLSSADATLGRHLARRLVQIGITDVFTVPGDFNLTLLDHLIAEPGLTNIGCCNELNAGYAADGYARSRGVGACVVTFTVGGLSVLNAIAGAYSENLPVICIVGGPNSNDYGTNRILHHTIGSPDFSQELRCFQTVTCFQAVVNNLEDAHELIDTAISTALKESKPVYISIGCNLAGIPHPTFSREPVPFSLSPKLSNKWGLEAAVEAAAEFLNKAVKPVMVGGPKLRSAHAGDAFVKLADASGFALAVMPSAKGQVPEHHPHFIGTYWGAVSTAFCAEIVESADAYLFAGPIFNDYSSVGYSLLLKKEKAIIVQPDRVTIGNGPTFGCVLMKDFLVGLAKKLKHNNTAYENYRRIFVPDGHPLKAAPKEPLRVNVLFKHIQKMLSAETAVIAETGDSWFNCQKLKLPPGCGYEFQMQYGSIGWSVGATLGYAQAVPEKRVIAFIGDGSFQVTAQDVSTMIRNGQRTIIFLINNGGYTIEVEIHDGPYNVIKNWNYTGLVDAIHNGEGKCWTTKVRCEEELIEAIETANGPKKDRLCFIEVIVHKDDTSKELLEWGSRVSAANSRPPNPQ

SEQ ID NO: 13882 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 13883 - protein, 278 aa, ASPERGILLUS NIDULANS FGSC A4
MDAIREVKYLQELSHPNVIALHDVFSSKDQNLNLVLEYLPRGDLEMLIKDSDIHYGAADVKAWMGMLIRGVWFCHENFVLHRDIKPNNLLIASDGEVKLADFGLARSFADPYMNMTHQVITRWYRPPELLYGARQYSGAVDIWSVGMVFAELLLRVPFVAGNSDLDQISKICEAFGTPTEESWPGREFFLRQFPTAGPVGADLLMSMCTLDPRRRTTAHQALQHRWWTTEPRPTNKQDLPQKPGGTKKMGDDLTRRGGELDDQFKNAARQLDFGAIKG

SEQ ID NO: 13884 - protein, 463 aa, Leuconostoc mesenteroides subsp. mesenteroides ATCC 8293
LFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 13885 - protein, 251 aa, Helianthus annuus
MGRGKVQLRRIENKINRQVTFSKRRGGLLKKAHEISVLCDAEVALIVFSNKGKLFEFSTDSCMESILERYERYCYSERQLVATDATPRSWTLEYNKLKSRAELLQRNHRHYMGEDIESLSLKEIQNLEQQLDTGLKNIRARKNQLLHESINELQKKGKAIQEQNTTLTKQLKEKEKDKTIPQNTQWEQHNYVDHDTTFFLPQPHPALNIGGDYNQATTSAASGGEGADGRTSQLDLSLQPIYSHHLRCFPS

SEQ ID NO: 13886 - protein, 205 aa, Haemophilus influenzae Rd
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICVDACPLRALDFAPIDELRTKYGTQASIAPLPPTDITQPNLVVKPNKYARLSGDTSGFLGNPREV

SEQ ID NO: 13887 - protein, 522 aa, Oryza sativa
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 13888 - protein, 461 aa, Porphyra variegata
  unsure (1)..(461): unsure at all Xaa locations
YWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSVICMIDLVIGYTAIQSMAIWARKHDMILHLHRAGNSTYSRQKNHGMBFRVICKWMRMAGVDHIHAGTVVGKLEGDPLMIKGFYNTLLESDTEINLPQGLFFAQNWASXRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 13889 - protein, 338 aa, Magnetospirillum magnetotacticum
MADKTIHVAGIGNAIVDVLVHADDLLLHRLGLTKGVMTLIDAEQAESIYAQLPPGIECSGGSAANTIAGIAALGGRAAYVGKVKSDQLGQVFRHDIRNMGVHFETEADDGGPSTARCFVLVTPDAQRTMLTYLGACVELGPDDVDIGLITGAEITYLEGYLYDPPEAKRAFLKAATVAHGAGRLVSLSLSDPFCVDRHRDAFLDLVAGHVDILFANESELCSLYKTESFDEAVRAVRGHCRVAAVTRGDKGSVVVTEDETQVVAADEIEQLVDTTGAGDLYAAGFLFGFTQGRDLATCAMLGGIAAGEVISHYGARPERSLKDLVRAKLGPHILENLR

SEQ ID NO: 13890 - protein, 84 aa, Triticum aestivum
MKVKILQWHAVASWTWDAQDETCGICRMAFDGCCPDCKFPGDECPIIWGACNHAFHLHCILKWVNSQTSTALCPMCRREWQFKG

SEQ ID NO: 13891 - protein, 135 aa, Zea mays
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRPGVSLKPGTPVEDVFPLVEAET

SEQ ID NO: 13892 - protein, 833 aa, Oryza sativa
MEGQSQHRAPEREGSHNYDIESTDGSGGLWRRNGSSSGALLRYNDSGGGRSGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKERYLTAFFAYGGCNLVLAAAAAAICAYIAPAAAGSGIPEVKAYLNGVDAYSILAPSTLFVKLIKFENLTVDMTVFIIDCWKYYEPVCSWYIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHARRFTGHNGFPVVDEPPLTEAPELVGLVTRSHLLVLLNGKMFMKDQLKTSGSFVLQRFGAFDFAKPGSGKGLKIQDLDFTDEEMEMYVDLHPVTNTSPYTVVETMSLAKAAILFRALGLRHLLVVPKTPDRPPIVGILTRHDFVEEHIHGLFPNLNPHKFHSTSMGG

SEQ ID NO: 13893 - protein, 575 aa, Arabidopsis thaliana
MQRLKQQQQQQQVMMQQALMQQQSLYHPGLLAPPQVCSILLPFPCSIWVSRLFFPSSISLTCFLCIRYISFKVFVLLSDIWFNNSMKIFEVRLIRYRSLVAETLGSKVFSFISFFFIFFGFLFFSFLQIEPIPSGNLPPGFDPSTCRSVYVGNIHIQVTEPLLQEVFAGTGPVESCKLIRKEKSSYGFVHYFDRRSAGLAILSLNGRHLFGQPIKVNWAYASGQREDTSSHFNIFVGDLSPEVTDAMLFTCFSVYPTCSFAETLPTIAIVCRDARVMWDQKTGRSRGFGFVSFRNQQDAQTAIDEITGECCNLFSPLIVDILFCFSGKWLGSRQIRCNWATKGATSGEDKQSSDSKSVVELTSGVSEDGKDTTNGEAPENNAQYTTVYVGNLAPEVSQVDLHRHFHSLGAGVIEEVRVQRDKGFGFVRYSTHVEAALAIQMGNTHSYLSGRQMKVKLTNLNCSFVGLTILFGLGMLKLLCSLFLQCSWGSKPTPAGTASNPLPPPAPAPIPGFSASDLLAYERQLAMSKMAGMNPMMHHPQGQHAFKQAAMGATGSNQAIYDGGYQNAQQLMYYQ

SEQ ID NO: 13894 - protein, 598 aa, Triticum aestivum
AASPAATSVAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNALLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPSGGAFKDMIMEGDGRTSY

SEQ ID NO: 13895 - protein, 595 aa, Saccharomyces castellii
MESSKKNETSPEVNSITSSTLKTPNVTEKFEPYPDTTAVKHRTHFNRFVDSFKRAEVNHNGIDLEDGTNSIQSDDNLKKAMKSRHVIMMSLGTGIGTGLLVANAKGLYLAGPASLVIGYFMVSFITYFVIQAAGEMAVTYPTLPGGFNNYASIFVSKPFGFATVWLFCIQWLTVLPLELITASMTIKYWNDKINADVFVVILYVFLLFIHFFGVRAYGEAEFIFNSCKILMIGGFVILSIVVNCGGAGVDGYIGGKYWRDPGAFASDNAASRFKGVAFVLVTAYFSYGGVELFALSVNEQENPRRSTPAAAKQSIYRILIIYLLTMILIGFNVPHNSDQLMGAGGSATHASPYVLAVSIHGVKVVPHIINAVILISVTSVANSALYASPRLLRSLAEQGYAPKYFNYVDREGRPLRALILCSIFGVIAFCACSDQEEVIFTWLAAIAGLSELFTWSSILLSHVRFRLAMKAQGKSLNELGYISITGIWGSLYGCFFNVLVFIAQFWVALSPPGSKGVYSAEAFFESYLAFPVWLFFYLGYMLYSRDFTFLTDLKKIDLDNHRRLYDPELLRQEDEETKERIRNGGWTQKLLNFWC

SEQ ID NO: 13896 - protein, 394 aa, Synechocystis sp. WH 8501
MSLSWMPRADRLNALPPYVFARLDELKAKAREQGLDLIDLGMGNPDGMAPQPVIDGAIAALQKPQTHGYPPFEGTASFREAITAWYRRCYRVDLDPSSEALPLIGSKEGLGHLALAYINPGDVVLVPSPSYPAHFRGPLIAGADLYPLILSAEKDWLIDLNSIPENVAKAAKILYFNYPNNPTTATAPRAFFEEIIKWATHYEIMLVHDLCYAELAFDGYQPTSLLEIPGGREIGVEFHTLSKTYNMAGWRVGFVVGNGEIIQGLRTLKTNLDYGIFSAVQAAAETALNLPDSYIKTVQERYQTRRDFLIKGLGELGWNIKPSQATMYLWVPCPTNTNSTDFALDVLEKTGIVFTPGNAFGEGGEGYVRISLIADCDLLGEALNRLKQAGIYYK

SEQ ID NO: 13897 - protein, 453 aa, Glycine max
MATHAALASTRIPTNTKFPSKASHSFPTQCASKRLEVTEFSGLRSTSCVTYANDARESSFFDLVASQLTPKQTNGSSTPVRGETVAKLKVAINGFGRIGRNFLRCWHGRKDSPLEVVVVNDSGGVKNASHLLKYDSMLGTFKADVKILDNETITVDGKPIKVVSSRDPLKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 13898 - protein, 395 aa, Ferroplasma acidarmanus
MKVSQYYTKKLSKFWGNRSLLLSRTLIGLAVGADSAIATAYIAEYAPKNRRGHLSLMQQWMITWGILGAYFVGMGVFFIAPQLAYTIDWRVLLGVAAIPSLIGLVFRFYMPESPRWLILHEKYDKAIASLKRFNVTAKLSEIKNTHDYLVAKETKQKATPGIKRAFVIVGLFMMFQQITGINIPFYYGPVVIAKLHIFGSTGGTAISSAVFGIEASSILAIINVLATLIGFRLIDSYGRRSLALLGYSGMAFFDVLGAVLYLSHIDIGLLIGFAGFIIFFAFGVGGTGWIIQGEYFPTQYRGLFASLIAVVDWISNFAIIELFPVMDLKIGLGYTMAVFAVLSIMAVVIFFYIMPKTKGKSVEEINDIFENNTLATVRNASMSGYSDNSKTDKKQ

SEQ ID NO: 13899 - protein, 703 aa, Xanthomonas axonopodis pv. citri str. 306
MAKSPSKSAQVPAVSPAASATPDVSRGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRTIEGFGIHSFRFLNEKGESTFVKFHWRPKLGLQSTIWDEAVKIAGADQDFHRRDLFEAIQRGDFPEWELGVQLFTEAQAETFPFDHLDSTKVIPEELIPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLNDGKQLAADGQLAGTPSVVFDAVAVLLSSEAAKLLTRESAALDFVSFAWAHLKAIAFDEGAQLLLKAGNVGKDAGVVPAADTKAFIAAAKTRQWAREPKVRMLA

SEQ ID NO: 13900 - protein, 379 aa, Oryza sativa (japonica cultivar-group)
MIGPAGLDSLHGLRRREFMATLHHLRARSGEPVNVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPERFLPADGGGGRRLDFTGSEQEYMPFGSGRRICAGVAMAERMVAYSLAMLVQAFDWELPAGERLDLAERFGIVMKKATPLVAVPTPRLSNPQLYSA

SEQ ID NO: 13901 - protein, 371 aa, Bacillus cereus ATCC 14579
MGTKTKKTLFNVDEQMKAIAAQFETLQILNENGEVVNEAAMPELSDDQLKELMRRMVYTRVLDQRSISLNRQGRLGFYAPTAGQEASQLASHFALEAEDFILPGYRDVPQLVWHGLPLYQAFLFSRGHFMGNQMPENVNALAPQIIIGAQIIQTAGVALGMKLRGKKSVAITYTGDGGASQGDFYEGMNFAGAFKAPAIFVVQNNRYAISTPVEKQSAAKTVAQKAVAAGIYGIQVDGMDPLAVYAATAFARERAVNGEGPTLIETLTFRYGPHTMAGDDPTRYRTKDIENEWEQKDPIVRFRKFLEAKGLWSQEVEETVIEEAKEDIKQAIAKADQAPKQKVTDLMEIMYEKMPYNLAEQYEIYKEKESK

SEQ ID NO: 13902 - protein, 319 aa, Oryza sativa
MAPVRLGAPTSGALLLLVLLLICGGGGGGGVAAGGGGGGGGGKGSSVYPAPVVYPHHSRQISWKPRVFLYQHFLSDDEANHLVSLARTELKRSAVADNLSGKSELSDARTSSGTFIRKSQDPIVAGIEEKIAAWTFLPKENGEDIQVLRYKHGEKYERHYDYFSDNVNTLRGGHRIATVLMYLTDVAEGGETVFPLAEEFTESGTNNEDSTLSECAKKGVAVKPRKGDALLFFNLSPDASKDSLSLHAGCPVIKGEKWSATKWIRVASFDKVYHTQGNCTDDNESCEKWAALGECIKNPEYMIGTAALPGYCRKSCNIC

SEQ ID NO: 13903 - protein, 579 aa, Chlamydomonas reinhardtii
MGCNPLQLAQVTALLGGDTATAATICAGTDVAQLGPNGAVTKWTVAELRGAQNALDQVEYGLNVSFVLASAYQVFVMQLGFALFAAGVVRPKNTVSIFIKNFFDTCIAGIAFYLVGYAFAFGAKDGYTNGFIGNWDFALSQTDGSPGSEPPNPWHLFIWNWSFCSASTTILSGSIAERATFASYTIYAAFMPAWVYPVVAHWLWAPDGWLSARNANDRILGIGAIDYAGSGVVHLVGGMAALIGSIAVGPRVGRFDAPGSTGEVSAQLYRATAAPQLYLMGTLLLWFGWYGFNPGSKLAISDYLQATIVSRTAVTTTLAACSGALSNLLLNYGRHRVWDLLSTCIGALAGLVAVTSGCSVIEPWAAIICGAISALFYEAGEQLLEKLKVDDPVSAFPLHAMCGVWGLLFTGLLANEGYITQVYNVPPGGHRMGLFYGGHAQLLLCQVIAIAVIAGWSAFNMCILFFGMKAAGLLRVGADKEATGMDMAACGQYNAAGAVNVHSSKVPTKSDAVLAAMSLNMERRMNGGPGMDYSVRNSSANPSAHNSSLHNTATATTVTTAAATPAAAGGIMLTSAVGG

SEQ ID NO: 13904 - protein, 652 aa, Enterococcus faecium
MAGLLVAMGVVYGDIGTSPLYVMKSIVEDNGGLSGINPDFVIGSVSLIFWTLTLLTTIKYVVIALNADNHGEGGIFSLYTLVRKGGKYLIIPAMIGGAALLADGVLTPAVTVTTAIEGLRGIPQFFDRFGNNQNVIVIITLVIIFVLFMVQRFGTDIVGKAFGPIMFAWFTFLGVMGLMNFSQDWTVIRALNPYYAIQLLFSADNKLGLFILGNIFLATTGAEALYSDLGHVGKRNIRLSWPYVKICLVINYFGQAAWLLNVYQNPEAQQIKNLNPFFQMMPQSWIVIGVAFATVAAVIASQALITGSFTLVSEAIKLKLLPRLKIMYPGNSIGQMYIPAVNLILWIACSLVVVTFRTSHHMEAAYGLSITVTMLMTTALLYFYLIQNGHSRWLAYLVTFFFGAIEVVFFISSVVKFFRGGFVAVLIGLIILVVMFIWEQGNIIRESSTEDVSLRDYIPQLRELRDDTSLPIYQTNVVFLVPDMAEDKVGRQFIYSILDKRPKRARVYWFVHVEVTDEPYTKEYQVDMMDTDFIVQVNLFLGFRVQQEINVYVRQVIHDLMKQGRLPKQPQRYSLTPGREVGDFQFVLIDEVVSNVTTLGKWQRQIMQAKLAIKKIATSPETWFGLEYSEVKHETVPLIIGNTRKTWLKERL

SEQ ID NO: 13905 - protein, 332 aa, Kitasatospora griseola
MTRIAINGFGRIGRNVLRALLERDSKLEVVAVNDLTEPTALGRLLAYDTTSGRLGRPVTVEGDVLVVDGRRIKVLAERNPADLPWADLGVDIVLEATGRFTSAEAARAHLAAGAKKVLVSAPSDGADVTLAYGVNTEAYDPAAHTIVSNASCTTNALAPLAAVLDELAGIEHGFMTTVHAYTQEQNLQDGPHRDPRRARAAGVNIVPTTTGAAKAIGLVLPQLDGKLSGDSIRVPIPVGSIVELNTTVSRDVTREEVLAAYREAAGGKLAGVLEYSEDPLVSSDIVGNPASSIFDSELTRVDGRHVKVVAWYDNEWGFSHRVIDSLELLAAS

SEQ ID NO: 13906 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLV

SEQ ID NO: 13907 - protein, 163 aa, Dunaliella tertiolecta
ASAQQPLNQQAPPPPTSFASQLQHTLGQQQFCDPTLIDRGLQHADKRRRDWIDVDALNEDDTQACSAYAVPIFEHLREAELVRRPNALYPEAFQTDVNAKMRAILVDWLVEVAEEYKLCADTLYLSVNYIDRFLSIHPVQRSNLQLVGIACMWIASKYEEIYP

SEQ ID NO: 13908 - protein, 506 aa, Methanosarcina mazei Goe1
MKTSSVELNPNRLVQYLKKPASEFTKDDIIKFVKDNGIKMLTFRYVGGDSRLKALSFIIRNEEHLDNVLSTGERVDGSSLFKYIEADSSDLYVVPKYRTAFVNPFEEIPTLDLLCSYFDKDGNPLASSAENIMKKAHAVLKEETGYELNAMAELEYYIISDKEMIDTDFPAVDQRGYHEAGPFTKFDQLRKDAMLAIAEAGGTIKYGHSEVGNFTDDKYYYEQNEIEFETTSLEDAADRLLIGKWILRMLAAQYGVSVSYAPKITVGKAGSGLHIHMKLLKDGKTATVENGGKLTDAAKKAIVGCLDIAGSITAFGNTIPTSYLRLVPHQEAPTNICWGDRNRSALIRVPLGWSGEASKMITIANPNYSEELKEHYYKQTYEFRAADGSADIYLLLAGLCVGTRHGLQMDNSLELADKLYINVNIFKEEHKDRLAQLEHLPASCYESAQALKKQKDIFMQYDVFTEGMLDGIISNLESYNDYQLSEKLYGKNEEIRKLVDNYIHIG

SEQ ID NO: 13909 - protein, 261 aa, Oryza sativa
  unsure (1)..(261): unsure at all Xaa locations
MWSFASNAIAGSIRKKAQPSKCSQSNPDCSDDDVSSCASREEGLECPICWESFNLVENVPYVLWCGHTMCKNCILGLQWAVVKFPTLPIQLXLFISCPWCNLISFRLVYKGKPQVPTQELIFLLWMVESMNGGRAKFHSPSHEERHSLCPSGGGPSSSQHHRRPAPRTESASGRERSVAGNVFNTYSISASLQKIMLSFVQMTAKFPLVIIFLLIVLYAVPASVAVLVLYVLVTVLFALPSFLILYFAYPSLDWLVREIFN

SEQ ID NO: 13910 - protein, 142 aa, Zea mays
  unsure (1)..(142): unsure at all Xaa locations
PSPAGIRVQSPAGKLTFTYCLEACKVDINPAKGGPYLNFKAKEQDGNKVFFSIKRSTLLSILMNPYCDRHSVHINAFAFLLDGRTLRXEHTPDHLEMQDGYXIDAVLHHTGGRVPSTTLEVSFCSSYCVVVNKQDKVFLRNL

SEQ ID NO: 13911 - protein, 311 aa, Zea mays
SARQAPFFRDLATPIPSHRGVSRFASGASPSAAPSATPPPPPIFTLDDLYASADFSPDPTASDLLPVASSPSPRAAASRSPPWDLSRGKVALSAPGSPMAGVVEPARKEVLALPPPASPGTPPPAATAEAQSPVSPAQAPARTEPVANGGEAEREEWITVFGFSIGVTNLVLREFEKCGVILRHHSGPRDGNWIHILYERSYDARKALQKNGMQLSNSLIVGVKPIDAVHRQQLDKGFTQSNQGGFMVSLPSKSLGLKSAGASNQLGALPRPYDPKANTNVSRDAGRRATGSVAAPTKSIVTNVMDLIFGI

SEQ ID NO: 13912 - protein, 417 aa, Mycobacterium tuberculosis CDC1551
MNLQLFLLLIVVVTALAFDFTNGFHDTGNAMATSIASGALAPRVAVALSAVLNLIGAFLSTAVAATIAKGLIDANLVTLELVFAGLVGGIVWNLLTWLLGIPSSSSHALIGGIVGATIAAVGLRGVIWSGVVSKVIVPAVVAALLATLVGAVGTWLVYRTTRGVAEKRTERGFRRGQIGSASLVSLAHGTNDAQKTMGVIFLALMSYGAVSTTASVPPLWVIVSCAVAMAAGTYLGGWRIIRTLGKGLVEIKPPQGMAAESSSAAVILLSAHFGYALSTTQVATGSVLGSGVGKPGAEVRWGVAGRMVVAWLVTLPLAGLVGAFTYGLVHFIGGYPGAILGFALLWLTATAIWLRSRRAPIDHTNVNADWEGNLTAGLEAGAQPLADQRPPVPAPPAPTPPPNHRAPQFGVTTRNAP

SEQ ID NO: 13913 - protein, 170 aa, Fusobacterium nucleatum subsp. vincentii ATCC 49256
MDLKNYVATIENYPKEGILFRDITPLMNNGEAYKYATEKIVEFAKEHHIDIVVGPEARGFIFGCPVSYALGIGFAPVRKPGKLPREVIEYSYDLEYGSNKLCLHKDSIKPGQKVLVVDDLLATGGTVEATTKLVEELGGVVAGLAFLIELVDLKGRERLSKYPMITLMQF

SEQ ID NO: 13914 - protein, 478 aa, Ralstonia metallidurans
MHAQHFVANRLIAPDSGLRIKVFDPSSGQPFAEIARGNATDINVAVHAARRAFDGAWGAMSPADRVRLLNRVALTLIEHEDELAALEARDTGKPLRQARADARAVARYFEFYAGAADKLHGQTIPYQAGYTVLTVREPHGVTGHIIPWNYPLQIFGRSVGAALAAGNACVVKPAEDACLSLLRVAELAAEAGLPEGALNIVTGYGHEAGAALARHPDINHISFTGSPETGKLVSQLAAENHVPVTLELGGKSPQIVFADADLDALLPVVVNGIVQNAGQTCSAGSRLLVERPVYEELLDRVASVFESLRVGPSELDLECGPLISRKQQQRVWDFVSDAQHAGISVMAQGQIVAEAPESGYYQVPMLFRDVPATHRLAQEEVFGPLLAAMPFDTEDEALQLANGTAYGLVAGVWTRDGGRQLRLARKLRAGQVFINNYGAGGGVELPFGGTGQSGYGREKGFEALYGFTTLKTIAIQHG

SEQ ID NO: 13915 - protein, 493 aa, Mesembryanthemum crystallinum
MDPYKYRPSSSYNTSFMTTKTGQPVWNDDSSLTVGARGPILLEDYHLLEKIASWDRERIPERVVHARGASAKGFFEVTNDITHLTCADFLRAPGVQTPVIVRFSTVIHERGSPETMRDPRGFALKFYTREGNFDLVGNNFPVFFNRDAMKFPDVVRAFKPNPKSHIQEMWRILDFCSHLPESLHTFAWFFDDVGIPINYRHMEGFGVHTFTMLNRAGKETYVKFHWKPTCGVKSIVTEEEAIQVGGANHSHATQDLYDSIAAGNYPEWRLFIQTMDPADEDKFDFDPLDITKTWPEDILPLQPVGRLVLNKNIDNFFTENEMLAFNPASIVPGIHFSHDKMLQARTFAYADTQRHRLGVNFLLLPVNAPKCAHHNDHHDGFMNFMHRDEEVNYFPSRSNVCHHAERFPIPSHTLTGRRERRIIPKENNFKQPGDRYRSWDPARQERYLARWVKALSDPKVTPEIRGVWVSWLSQSDRSLGMKLANKLNVRPTM

SEQ ID NO: 13916 - protein, 71 aa, Zea mays; identical to SEQ ID NO: 11981

SEQ ID NO: 13917 - protein, 408 aa, Synechocystis sp. WH 8501
MTMISVQDAQTIILDLVTSLQETETIELDQATGRILAEAVTSGLDFPYWDNSAMDGYGVRFEDVNQGDTNQPITLKIVAEIPAGIKPEISIRSREACRIFTGAMLPDGVDTIIIQEKTQKQGTQVIVLSPPQYCGEFVRKKGNFYQSGDILLSAGTKINEPEMAILATAQCSQVKVYRRPRVAILSTGNELITTTEKLEPGQIIDSNQYALKAFIIKNGGIPISLGIVKDEPALIKQKILEAINTADFVLSTGGVSVGDYDYIDNILLEVGGEISVDSVAMKPGKPLTVAKFDNGCVYFGLPGNPVSALVGCWRLVKLALDKFSGIKGEHKPQLITVKSAHDLSSQGKRETYIWGQLKPVNGEYLFSLAKGQQNSANLINLGLTNALAMLPIGVTKIKEGETVTVLML

SEQ ID NO: 13918 - protein, 332 aa, Glycine max
MERIMIRCRSQQTYLFLFCPSMEGSGSGVVTVYGNGAITETKKSPFSVKVGLAQMLRGGVIMDVVDAEQARIAEEAGACAVMALERVPADIRAQGGVARMSDPQLIKDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKNIAAPYDLVMQTKQLGRLPVVHFAAGGVATPADAALMMQLGCDGVFVGSGVFKSGDPAKRARAIVQAVTHYSDPEILAEVSCGLGEAMVGINLTDDKVERFANRSE

SEQ ID NO: 13919 - protein, 462 aa, Botrydiopsis intercedens
SGVIPYAKMGYWDADYNVKHTDILALFRITPQPGVDPVEAAAAVAGESSTATWTVVWTDLLTACDIYRAKAYRVDPVPGTTDQFFAYIAYECELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRASAATGEVKGSYLNCTAGTMEEMYERAAYAKITGTIIVMIDLVIGYTAIQSMAIWARKNDMILHLHRAGNSTYARQKNHGINFRVICKWMRMAGVDHIHAGTVVGKLEGDPLMVKGFYNTLLDTKLDINLPQGLFFQMDWAALRKVVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPD

SEQ ID NO: 13920 - protein, 488 aa, Vaucheria frigida
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYIAYQCELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGVNRAAAASGEVKGSYLNTTAGTMEEMYERAEFAKQIGTIIVMIDLVIGYTAIQSMSIWARKADMILHLHRAGNSTYARQKNHGINFRVICKWMRMAGVDHIHAGTVVGKLEGDPLMVKGFYNTLLETKLDINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 13921 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 13922 - protein, 255 aa, Arabidopsis thaliana
MFVVTKHLLQRRKRSSSSSSCYDDFFKRLQNHGAWFKKHLTTQLFSVTKKKKLHLVLDLDHTLLHSVLVSDLSKREKYLLEETDSRQDLWRRNVDGYEFIIKLRPFLHEFLLEANKLFTMHVYTMGSSSYAKQVLKLIDPDKVYFGKRVITREASPFNKSLDLLAADKRRVVIVDDTVHVWPFHKRNLLQITKYIYFKVDGTKWDSYAEAKKDESQSNGSLANVLKFLEVVHKRFEEDLGFKDLRLLIPCRQRCY

SEQ ID NO: 13923 - protein, 528 aa, Triticum aestivum
MAHVHVDELLHEAAAAAPRSLLIASAVLFSLVVVPLLLRIISKQGAASDAKLLSLLPSPPTKLPIIGHLHLMGDLPYVSLAGLAAKYGPELMLVHLGAVPTAVVSSPRTAEAVLRTHDHIFASRPRSMVFDIIMYGQTDSCFAPYGEHFRKARKLVTVHMLNARKIRSQRPARVEEVRLVIGKIAKAAAAREAVDMSELLHSYVNDLVCRAVSGKFSQEEGRNKLFRELTDINAALLGGFNILDYFPSLGRFELVCKMACAKARRVRKRWDLLLDKLIDDHAARMVSREDEAQPAQEEDKDFIDVSLSLQQEYGLTRDHIKAILIDMFEAGTDTSYMTLEFAMAELIRKPHLMKKLQEEVRRNVPNGQEMVAEDDLPNMTYLKAVIKETLRLHPPVPLMIPHFSLDACTVDGYTIPANTRVVINAWALGRHSSYWENENEFQPERFMNGAGVDLKPNEFHYLPFGFGRRMCPGVHSASATVETMLANLMYRFDWKLPPGLKEEDIDMTEVFGITVSRKEKLILVPVTA

SEQ ID NO: 13924 - protein, 145 aa, Triticum aestivum
  unsure (1)..(145): unsure at all Xaa locations
FVKAPGGAPANVAIAVARLGGGAAFVGKLGDDEFGRMLAKILRDNGVDAGGVVFDPGARTALAFVTLRAXGERXSCSNRNPSADMLLTAERVKXRLIKEGCIFHYGXIXLIXXACXTTHLTHEVAKXAGASLXYDPNXRRILASL

SEQ ID NO: 13925 - protein, 107 aa, Zea mays
DHSNFVNCIRYAPDGSKFITVSSDKKGLIYDGKTGEKIGELSTEGGHTRSIYAVSWNPDSKQVLTVSADKSAKNDHLVTVSLGGTFNVFSASNPDQEPVTFAGHLKT

SEQ ID NO: 13926 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAQQTPLSALYAAKLIKEAPFPAGVINVISGFGRTAGAAISSHMDIDKVAFTGSTLVGPTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDVAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 13927 - protein, 385 aa, Nicotiana tabacum
KLKVAINGFGRIGRNFLRCWHGRKDSPLDVVVVNDSGGVKNASHLLKYDSMLGTFKADVKIVDNETISVDGKHIKVVSSRDPLKLPWAELGIDIVIEGTGVFVDGPGAGKHIQAGAKKVIITAPAKGADIPTYVVGVNEQDYSHEVADIISNASCTTNCLAPFVKVMDEELGIVKGTMTTTHSYTGDQRLLDASHRDLRRARAAALNIVPTSTGAAKAVSLVLPQLKGKLNGIALRVPTPNVSVVDLVVNVAKKGITAEDVNAAFRKAADGPLKGVLAVCDEPLVSVDFRCSDVSSTIDSSLTMVMGDDMVKVVAWYDNEWGYSQRVVDLAHLVANNWPGSCSTRKWRSHWMSFARQILLMRNAKSMNNRFCYVSSFEMDDFRSQ

SEQ ID NO: 13928 - protein, 459 aa, Chrysochromulina hirta
DPDYAIKETDILALFRCTPQPGVDPVEAAAALAGESSTATWTVVWTDLLTACDLYRAKAYRVDPVPSTPDTYFCYVAYDIDLFEEGSLANLTASIIGNIFGFKAVKALRLEDMRFPVALLKTYQGPATGLIVERERMDKFGRPLLGATVKPKLGLSGKNYGRVVFEGLKGGLDFLKDDENINSQPFMRYRERFLYSMEGVNHAAALSGEVKGHYLNTTAATMEDMYERANFAKELGSIIVMIDLVIGYTAIQSMGKWSRDYDMILHLHRAGNSTYSRQKNHGMNFRVICKWMRMAGVDHIHAGTVVGKLEGDPLMIKGFYNTLLDFKSEVNLPEGLFFAQDWASLRKCVPVASGGIHCGQMHQLINYLGDDCVMQFGGGTIGHPDGIQSGATANRVALECMVLARNEGRDYVAEGPQILRDAAKSCGPLQTALDLWKDITFNYASTDTADFVETPTANV

SEQ ID NO: 13929 - protein, 432 aa, Zea mays
MGFGMGNNNNGASSSSSRLDPAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFAVDVMLVLSQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 13930 - protein, 557 aa, Triticum aestivum
MDSARSWFQKFQPRDKSKSPAVPASHGKDPGKPPVDDAPSSATKQKVAAAKQYIENHYKTQMKSLQDRKERRWMLERKLQDAEVPAEEQNNILKHLEKKETEYMRLQRHKMGVEDFELLTIIGRGAFGEVRLCREKTSKSVYAMKKLKKSEMLRRGQVEHVKAERNLLAEVDSAYIVKLYYSFQDDEFLYLIMEYLPGGDMMTLLMRKDTLTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 13931 - protein, 312 aa, Bradyrhizobium japonicum USDA 110
MTDWTTADIPSLSGRTAVVTGATGGLGYETAMALAGAGAIVILTGRNDAKGLRAIEGICERFPDALIAYEHLDLASLSSVADFAKRFAAGNEQLDLLVNNAGVMALPKRQQTEDGFEMQLGTNYLGHYALTARLLPQLRRAKASRIVNLSSLAHRSGAINFDDLQGKRSYRPWRAYCQSKLAMLMFALELQRRSLAAGWGVTSVAAHPGYARTDLIANGPGANTLQWRVGRWLQPFISQSAAEGALPTLFAATSPAAEPGGYYGPNRFYELKGPPAPAKITPQARDFAAAAMLWDVSATLTGVSFDDIAVAA

SEQ ID NO: 13932 - protein, 562 aa, Magnetospirillum magnetotacticum
MTVATLESLAERRGADVLVEVLRSEGVRYVFGNPGTTELPLIDALTDASDIAYVLALQEASAVAMADGYAQAARRPGFLNLHTAGGLGHGMGNLLNAQISGTPLVVTAGQQDSRHVITDPLLFGDLVTIASPTVKWAREVTHADQLPVLLRRAFHDSTAAPSGPVFLSLPMDVMEARTTAPLGEISTIDHRPVAGSLDRLADRLAAIPPGRLALIAGDEVDMSDAAAQAVRLADLLAAPVYGSSWPAHIPFPSAHPLWMGNLPTKASGIAEILGRYDAVFALGGKSLITVLYTEGSAVPPGTQVFQLSADARDLGRTYATQLSTVGDVRASLDVLIPLLEDRVAPRAEAYARLRSEAVQAYDARRAALAAKAEAAFADPVIHPLVAASEIAHAVGAGIAIVDEAPATLGHLRTFLHSTWARQYSSIRGGVLGWGMPASVGYSLGLDRAPVVCIVGDGAAMYSPQALWTAAHERLPVTFVVINNAEYNILKQFMKSQTHYASVRANRFIAMDLTEPRIDFPALAASMGVPARRVERAGDIAGAVEAGIRSGEPNLVEIVVSAA

SEQ ID NO: 13933 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 13934 - protein, 415 aa, Polysiphonia fibrillosa
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALESMVIARNEGRDYVAEGPQILLDAAKTCGPLQTALDLWKDITF

SEQ ID NO: 13935 - protein, 324 aa, Pavlova lutheri
SKVGINGFGRIGRLVFRIAMARDNMVVKHINSPMAPEYMKYLLSYDSAHGRYKGTVEVDAKGSLIVDGLEVTLTATRDPTEIPWGKRDVAYVCESTGAFTSTESCMLHVTSANPAKKVVISAPAKDAETPTLVVGVNAAEDYKTSMNVVSCASCTTNGLAPLVKHIDQTYGIAEGLMTTVHATTASQLTVDGSMKGSDWRAGRAAAANIIPSSTGAAKAVAKCYPASKGKLTGMAFRVPTIDVSVVDLTCRLVKSTTYDELKASVKAASEGSMKGILGYTEDQVVSQDFVGSEMSTTFDAGAGIMLNPNFVKLISWYDNEWGYS

SEQ ID NO: 13936 - protein, 290 aa, Staphylococcus aureus subsp. aureus Mu50
MNKLRDTTFLSYLFTIILWGSAFPMIKIALNDFSAESLSAFRLILATIILLPFVIIKKLPTPELRDIPVIFILGFCGFVIYHTALNFGETLISAGISGILVSTTPIFSSALAYIFLKEHFSKWNWLSSLVAFIGISIISISKDDYTTINVLGVFIILLASFSESLYFTFQKKYIEKYGFIAFTLYTIMASSPFMLIFIPEIINDIHGATFTSIVSVLYLAIFPTIIPYVLLAYIVKSVGVSDATMSLYLTPIVSLLLSYLLLDELPTTLAIIGGIITLLGVSLSNFFQNT

SEQ ID NO: 13937 - protein, 451 aa, Spinacia oleracea
MASHAALAPSRIPASTRLASKASQQYSFPTQCSFKRLDVADFSGLRSSNSVTFTREASFHDVIAAQLTTKPTGAAPVRGETVAKLKVAINGFGRIGRNFLRCWHGRKDSPLDVVVVNDSGGVKSATHLLKYDSILGTFKADVKIIDNETFSIDGKPIKVVSNRDPLKLPWAELGIDIVIEGTGVFVDGPGAGKHIQAGAKKVIITAPAKGSDIPTYVVGVNEKDYGHDVANIISNASCTTNCLAPFVKVLDEELGIVKGTMTTTHSYTGDQRLLDASHRDLRRARAAALNIVPTSTGAAKAVSLVLPQLKGKLNGIALRVPTPNVSVVDLVVNIEKVGVTAEDVNNAFRKAAAGPLKGVLDVCDIPLVSVDFRCSDFSSTIDSSLTMVMGGDMVKVVAWYDNEWGYSQRVVDLADLVANKWPGLEGSVASGDPLEDFCKDNPADEECKLYE

SEQ ID NO: 13938 - protein, 216 aa, Halobacterium sp. NRC-1
MRGQPVHRRSVLALVGGGAVSALAGCTDTTDGDATTTTPEPTPRSETQPTPTATDDIPIAGPSPDFGGLGLASNAFADGAAIPDRYTRSGADVNPPLSIAGVPEDAATLVLVVDDPDAVDPAGEVWLHWLVWNIPASRTRIPAAWTPTEPTVGTNDFGERDYGGPAPPDDTHLYRFKLYALDTTLILPQDATERTVGNAVRGHVLASTQLVGSHAP

SEQ ID NO: 13939 - protein, 384 aa, Arabidopsis thaliana
MALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 13940 - protein, 153 aa, Triticum aestivum
  unsure (1)..(153): unsure at all Xaa locations
MAPTVMASSATSVAPFQGLKSTAGLPVSRRSNGASLGSVSNGGRIRCMQVWPIEGIKKFETLSYLPPLXAXEALLKQVDYLIRSKWVPCLEFKXRLGFIFREHNASXPGYYDXRYWTMXWKLPMFGCXXXTHVINQVXXVXKEYPDAYVRNHR

SEQ ID NO: 13941 - protein, 548 aa, Salmonella typhimurium LT2
MEIFFTILIMTLVVSLSGVFTRVLPFQLPLPLMQIAVGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 13942 - protein, 289 aa, Gluconacetobacter xylinus
MIKPLKKAVLPVAGLGTRFLPATKCVPKEMLTVVDRPLIQYAIDEAREAGIEEFCLVSSRGKDSLIDYFDISYELEDTLKARKKTSALKALEATRVTPGSMLSVRQQEPLGLGHAIWCAREFIGNDPFAILLPDDVVQSEKSCIGQLVEVYNKTGGNVLAVTEVPREQTGSYGILDVGADDGKTVEVKGLVEKPDPKDAPSTLSVIGRYVLTADVLKHLAKLEKGAGGEVQLTDAMAKTIGHVPFHGYRYEGKRFDCGSKPGFLEAQIAFALAREDLAGDVREFLKKYK

SEQ ID NO: 13943 - protein, 159 aa, Corynebacterium efficiens YS-314
MTTSALVLVSSTRAAAGEYTDRSGALLVEWLRGRGIDVPDARVVADADLPGALAGVLGDAARPDVVLISGGTGLTPDDRTPELLAPYLDRELPGIVHAFWNKGMESVPTAVLSRAVAGTIGATFVMALPGSTGAARDAVAVLDPLLDHLVSTLKGHHDH

SEQ ID NO: 13944 - protein, 344 aa, Corynebacterium glutamicum
MPIATPEVYNEMLDRAKEGGFAFPAINCTSSETINAALKGFAEAESDGIIQFSTGGAEFGSGLAVKNKVKGAVALAAFAHEAAKSYGINVALHTDHCQKEVLDEYVRPLLAISQERVDRGELPLFQSHMWDGSAVPIDENLEIAQELLAKAKAANIILEVEIGVVGGEEDGVEAKAGANLYTSPEDFEKTIDAIGTGEKGRYLLAATFGNVHGVYKPGNVKLRPEVLLEGQQVARKKLGLADDALPFDFVFHGGSGSEKEKIEEALTYGVIKMNVDTDTHYAFTRPIVSHMFENYNGVLKIDGEVGNKKAYDPRSYMKKAEQSMSERIIESCQDLKSVGKTTSK

SEQ ID NO: 13945 - protein, 405 aa, Desulfitobacterium hafniense
SYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 13946 - protein, 170 aa, Archaeoglobus fulgidus DSM 4304
MVLMHEKDVSYEVAVITVSTSRYERHGEVRGVEKIPEDDASGKLLVENFNASQYFLVPDDVMRIQKAVLEALVRADVCLITGGTGLNPRDVTIEAVEPLFTKKIEGFGELFRMLSYQEVGYSAILSRATAGLVNDKAVFCLPGSSKAVRLAAEIIKGSLKHILSHAKGMS

SEQ ID NO: 13947 - protein, 117 aa, Methanopyrus kandleri AV19
MTDPELERIRRKKIMELQRKLEESQEKKVEEEREKKALEEAQRRAMLRRILTPEARERLARVRLARPQLAQAVENYLLQLAQTGQLKEKIDEDQLKRILKQVSDATRKEYRIRFKRK

SEQ ID NO: 13948 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYPIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 13949 - protein, 654 aa, Oryza sativa (japonica cultivar-group)
MFSWSRKQSSSSGRRGADASSMDSSSRGGGGEGSGSGSRGRSSRLERRNAVKHIDYEAAGAGAGAGASSVPACASWSSSMSADRSLGLRPSRSLDLAVGGGGTDIRISGSVEGEVDELCRSLGLSGPEEFAIPVAAWEARKERSNSDLLPRSRFVSSPPVDDPSPMARTISAPEVIQCDLPPSFPASIPEESLNSSSNSTATDSAEEPTAAALGQESPKAAPAVAAVAPLAGLPLLSPKRGGGEVGIRGARPPVLSPPQPLMALAPPPMRRSIVAKDMSGVSAWDIVNSFAPSEEKSEVRTDDERVDASHMSDTEEEEEFADEGVAGVDGELKELRIGETFEGFTGTSSLSTTNDDDASSTTTEAMFIISPNGKFKRKIKSWMRGALLGSGSFGMVYEGISDEGAFFAVKEVSLLDQGSNAQQSILALEQEIALLSQFEHENIVQYYGTDKEESKLYIFIELVTQGSLSSLYQKYKLRDSQVSAYTRQILNGLVYLHERNVVHRDIKCANILVHANGSVKLADFGLAKEMSKINMLRSCKGSVYWMAPEVVNPKKTYGPQADIWSLGCTVLEMLTRNIPYPNVEWTNAFFMIGKGERPQIPSYLSKDAQDFISQCVQVDPEQRPSASQLMSHPFVNRPLRASFESASPPAISSY

SEQ ID NO: 13950 - protein, 142 aa, Desulfovibrio desulfuricans G20
MVDSMFSGFGMPSPRRLFDAASPMLGKSVIKPKVDIYGTDKEYVVEVDLPGIEEKDLSVELKDDVLILSAEKKHEEKTEEKGYYRVERSYGSFRRVLNVPDDADKEGINAKLNKGVLRITMPRNKAIETESRKIAIESSKED

SEQ ID NO: 13951 - protein, 338 aa, Shigella flexneri 2a str. 301
MQKKSIYVAYTGGTIGMQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAPNYPINEVTLFFNNRLYRGNRTTKAHADGFDAFASPNLPPLLEAGIHIRRLNTPPAPHGEGELIVHPITPQPIGVVTIYPGISADVVRNFLRQPVKALILRSYGVGNAPQNKAFLQELQEASDRGIVVVNLTQCMSGKVNMSGYATGNALAHAGVIDGADMTVEATLTKLHYLLSQELDTETIRKAMSQNLRGELTPDD

SEQ ID NO: 13952 - protein, 152 aa, Glycine max
  unsure (1)..(152): unsure at all Xaa locations
LRSYSALQADDRFWPADYGGPLFLLPGLVIGLSVTGVLNVVLTPEHQSEMRRYLFNHQNEDGGWXSHIEGSSTMFCTALNYVTLRLLGEDIDGGEGAIQKARTWILHHGGVTYIPSWGKLWLSVLGVYEWSGMKPIPPETWLFPYFLPFHPG

SEQ ID NO: 13953 - protein, 507 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 13954 - protein, 549 aa, Oryza sativa; identical to SEQ ID NO: 13230

SEQ ID NO: 13955 - protein, 704 aa, Zea mays
  unsure (1)..(704): unsure at all Xaa locations
MRPSAAAAPLPPSSSEKAATGARVEAAVVESQVVERLVELVSEIAAVSDHLSNGVSSSCNLSRRIRLLVPMLEEAKEAPTPLTVASKAALRRLREALHAARDLLQLGSSGSKIFLVLDREKIMKTFQDVTARLEHALAAISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEXRPQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSXAEHSNVLELLRRLARRPGEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAHAQAQAQAQPQILVQAQAHADMQAERSLLPTSSDISDR

SEQ ID NO: 13956 - protein, 331 aa, Triticum aestivum
MTQNLGISVPIMSPSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQVCFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 13957 - protein, 230 aa, Helicobacter pylori 26695
MALYDRANSRNAYAEDSLLRESELVSFVKTTYKFFAGSLLLATIGALLGLMNFQAVVQYKWVFFIAEIAAFFGLMFSKSKPGLNLFMLFAFTSLSGVTLVPLLGMVIAKAGLGAIWQALGMTTIVFGLMSVYALKTKNDLANMGKMLFIALIVVVVCSLINLFLGSPMFQVVIAGASAILFSLYIAYDTQNIVKGMYDSPIDAAVSLYLDFLNVFISILQIIGIFSDRDT

SEQ ID NO: 13958 - protein, 371 aa, Oryza sativa (japonica cultivar-group)
MDQNQPIPFPAPLSTTGTDADDAELLQAQAELCCHAWRHMESMALKCAIDLGIPSAIHRNGGSASLPDLLATLPIAENKRPFLHRLMRFLTVSGIFTSADDGVYQLTRVSRLLVDSIPLNLLPFAETVSVQSGNFHTVFTRNFRSFLCLGEWFRDGGDTTPFAMAHGIDVWGAMSLDRALAAGFSASMAADSKFLAEIAIRRHVEAFMNVSSLVDVGGGDGSMARAIVKAFPHIKCLVLDLPHVVRGIPADGFVEYVAGDMMDFVPPANVVLLKLVLHDWSDEDCVRILSRCREAISNREGGKVIIIDTVIGSQSQQIYEAQLFLDLCMMTVTTGKEREEKEWHMIFLKAGFTQYKILPILGIKSLIEVYP

SEQ ID NO: 13959 - protein, 432 aa, Glycine max
MSFTATKFSPSPLPLTSTTPRSNDKPLSFSFDHSKPNPSSSFLGSTRKLLRFNALARPHAHPRASSSPAAAVLLERTSNLLVTKEEGLELYEDMILGRFFEDKCAEMYYRGKMFGFVHLYNGQEAVSTGFIKLLKKEDSVVSTYRDHVHALSKGVPSRQVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGPAFGMPGVHVDGMDVLKVREVAKEAVERARRGDGPTLVECETYRFRGHSLADPDELRDPAEKEHYAGRDPITALKQYLIENNLANEQELKAIEKKIDEILEDAVEFADSSPLPPRSQLLENVFADPKGFGIGPDGRYRCEDPKFTEGTAHV

SEQ ID NO: 13960 - protein, 533 aa, Neurospora crassa
MRSSLLTGAIAAALSFSGYAAAADADAWKSRSIYQVMIDRFARDDGGSVDCKLYEFCGGTWKGLTNKLDYIQGMGFDAIQISPVIKNEDKNTAVGEPYHGYWSQDLTQVNPKFGTEEDLKNLIAEIHKRDMFLMVDVVVNHMAQEFDNVVPPKVDYSVFKPFNDKKYFHPYCNVTEWENATNIQDCWLYPYGIALADLKTESPDVVSLFTKWIKNLVSTYSIDGLRIDAAKHVNDEFLPQFVQASGVFALGEVLTGVTEDMCRYQNKSKNLLPGMPNYLDYYPLNAAFNGGSFERLGEIRAQAQDSCNDTLALGTFIENHDMPRFASQNQDMALAKNAMTYVIMNDGIPTVYQGQEQHFTGGATPENREPLWKSNYNTSAPLYVLAQTLNKVRKNAIKQSPTYVKQTSNVLIADTNHFCQQKGPAENSVVFCVTNKSSKGDSYQMPVGGFRDSDEVVEVLSCATTTADGLGQITAYMGAGEPKVWVKKSALEGTDICTKTTVDGPKEENGAVSKGAATGVLMAAVLGTASLLL

SEQ ID NO: 13961 - protein, 414 aa, Oryza sativa
MATLPGGPHPTGGGAAADPMQVDQPRSAAAAAAVAPAGEKHGASLMEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYVYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRWMNPNYTEFRFPQIKAHPWHKIFHKRMPPEAIDLASRLLQYAPNLRCTALEACAHSFFDELREPHARLPNGRPFPPLFNFKQELANISPELINRLIPEHARRHCGFNFLPAAGP

SEQ ID NO: 13962 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPAIHYSDDKLLQTRIFSYADTQRHRLGPNYLMLPVNAPKCAHHNNHHDGFMNFMHRDEEVNYFPSRFDPARHAEKVPIPPRVLTRCREKCIIQKENNFKQAGERYRSFDPARQDRFIQRWVDALTHPRVTHEHRTIWISYWSQCDAALGQKLPSRLNLKPSM

SEQ ID NO: 13963 - protein, 317 aa, Zea mays
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 13964 - protein, 782 aa, Saccharomyces cerevisiae
MTSYIERLKSAASYLDTVPDEHHDFRKPTAKVVTTQLTIATSLGIFALLSFSILLKKWPRLYASRRYKDDGNLRLPSWNQSSLFGWLTVLYKIRDEQILEYAGLDAYVFLSFFKMCIKLLSIFCFFSVCVISPVRYHFTGKIDDGNDDDDSESSLIHLVKRIVEGSGDGDNHSAPERTNVYLWMYVLFTYFFTFIAIKMAVAETKHVVSTRQAYLGKQNTITDRTIRLSGIPIELRDSEALKTRIEQLKIGTVSSITICREWGPLNKLFHCRKKILKNLELKYSECPRELRTRQPYSENYHLLGNEQSGAVTHGENVPSSNNNDEDTILYSQISLGERPKMKIGYRGIFGKEVDAIEYLEQQLKFIDAEIIEARKQHYSATPTAFVTMDSVANAQMAAQAVLDPRVHYFITRLAPAPHDIKWDHVCLSRKDRLTKVYSTTVFIGLSSLFLVIPVSYLATLLNLKTLSKFWPSVGQLLKDHQWAANIVTGLLPTYLFTLLNFGIPYFYEYLTSYQGLVSYSEEEISLVSKNFFYIFVNLFLVFTLAGTASNYWAYLSDTTKIAYQLATSVKEFSLFYVDLIILQGIGMFPFKLLLVGSLIGFPLVKIKAKTPRQRNELYNPPIFNFGLQLPQPILILIITLIYSVMSTKILTSGLAYFIIGFYVYKYQLIFATDHLPHSTGKVWPLIFRRIIVGLLLFQLTMTGTLAGFEGGWVLSSCLFPLPVVTLCFLYDFEKNYLPLSKYIALSSIREYERDNSTVNSANEEESYAYPYAVSELEGPMLD

SEQ ID NO: 13965 - protein, 550 aa, Actinobacillus pleuropneumoniae serovar 1 str. 4074
MNGANLVIESLKAHGVTTLFGYPGGAIMPTYDAIYDSGLDHLLVRNEQGAAMAAIGYARATGKVGVCIATSGPGATNLITGLGDAALDSIPVVAITGQVASHLIGTDAFQESDVLGLSLACTKHSFIVQNIEELPEIIARAFQIAQRGRPGPVLVDIPRDIQLALTSAKPIVYEKQAVEAQNQDLLNEAKTLLANAKRPVLYVGGGVGMAGGVQAVRNFLKVTNIPSVSTLKGLGTITIDDPLYMGMIGMHGTKAANYAVQECDLLIACGARFDDRVTGKLDTFAPHAKVIHIDIDIAEINKLRKVEVALRGDLVEAVNTLAQPLDIDPWREDVKRLKADLDFQYVDNAGEGDINAKALLNTLSQRKPKNAIITTDVGQHQMWSAQHLQHFAPENFITSAGFGSMGFGLPAAVGAVKARPQDPVILVTGDGSIMMNIQELGTLKRGHLPVKIVLLDNQRLGMVRQWQSLFFHGRHSNTILDDNPDFVVLASAFGIQGERIEKASEVSDALDRLLNAKGAYLLHVCIPEEDNVWPLVPPGACNADMLDDEI

SEQ ID NO: 13966 - protein, 371 aa, Oryza sativa (japonica cultivar-group); identical to SEQ ID NO: 559

SEQ ID NO: 13967 - protein, 860 aa, Aspergillus niger
MRFTLIEAVALTAVSLASADELAYSPPYYPSPWANGQGDWAQAYQRAVDIVSQMTLDEKVNLTTGTGWELELCVGQTGGVPRLGVPGMCLQDSPLGVRDSDYNSAFPAGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGFGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGYKYYYVSEGPYEKVNQYVNVQRNHSELIRRIGADSTVLLKNDGALPLTGKERLVALIGEDAGSNPYGANGCSDRGCDNGTLAMGWGSGTANFPYLVTPEQAISNEVLKHKNGVFTATDNWAIDQIEALAKTASVSLVFVNADSGEGYINVDGNLGDRRNLTLWRNGDNVIKAAASNCNNTIVVIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASDYLYPSGLQRITKFIYPWLNGTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKLPLRASLPTVH

SEQ ID NO: 13968 - protein, 693 aa, Neurospora crassa
MDDDVMRPDTHHDPTPGLIPVPHGPATGDEALQLPFGHTPDPDHEKAIFGYLTQPDDIYTKDGTYWADLPLRERIAFVNKVQNEEAKQELKAIGRMMKKDPLSPVSWYFRNAVLPGAGLGLEGYVLFSIGNIEPLFKATWPQCWGHNATECSSNWIAAVTYLEVIGIMVGQLVVGVIGDWIGRRWGLIQDAAIMFVGLLMLTASWGFGVGGEYPITATSSMENSVASGKLSTRNDRLHRGRKVTTAFLMQGWGQLINQALLIILLLIFHAGSGSPPYGLATVQWTFRLSFAIPAVGTLWLVYYRTYKMPHASRQLIAAKKKTNVTGYDFDSLAMTTRHFGGRLLATAGCWFCNDVFFYGNKLFQAQFIAVISGGSSSVLTGWIWNLYNVIISLVGYYLASLLMDNRFYGRKMMQQVGFLMCFIMFVVPAFKLEYYTSPAGIKSFQAMYFLSSFFNQFGPNSVTFLVAGEVFPTPIRASAHGFSACCGKAGALLASVLYNYIDTQTKFYVVPWFGLAGMILTWLFLPDTTGLDLKEQERRWSYIRAGKPEDYHGIAIHPMHLSLWERLRGVGKHYNPELDHKQKIEDMREEWAGKERMRREKEVNGQNSMGDDLEVDDFNDQVHHYFRNTTDQGMFVNDGSAGPSTHSRSRNNSEPPFASGANSKEVTQEKIRPDSPSTTQTPSSTRPVSEKEQ

SEQ ID NO: 13969 - protein, 745 aa, Oryza sativa (japonica cultivar-group); identical to SEQ ID NO: 1275

SEQ ID NO: 13970 - protein, 479 aa, Fusarium sporotrichioides
MAENLTSDVPGPAGIPYFGNYLEIYPDHLGNHQRLFEKYGPLFTTSSMGNRLYQTNNSELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADNVVDYFLRATDNKGNKLPPSQFAPALLVATAAGFTTTSSLLSWLIYSLVKYPGNQERLLQELIDNDWDEDTQVTADTTSKLTFLEKFIKETQRLHNPSFQPGRTAKVDMILPGGYRLPKGAVVISALHHMHNNKDVWENPGRFDPDRWDTEQVKNRPPGSYIPFATGPRMCIGFNFALQEIKVFLPKLVYRYKFSLAQDGPIEYDPYFQLIRPNNLYVQAEKRVKWPPKSE

SEQ ID NO: 13971 - protein, 58 aa, Glycine max
  unsure (1)..(58): unsure at all Xaa locations
MEWCSELPDPSVEVXLTCSDGTFARAAVPSGASTGIYEALELRDGGSDYLGKGVSKAV

SEQ ID NO: 13972 - protein, 209 aa, Triticum aestivum
MEDEEHEVYGQEIPVDGEDVDMGAGGDDAAKLHELDEMKRRLKEMEEEAAALREMQAKVAKEMQGGDPNATTSEAKEEMDSRSVFVGNVDYACTPEEVQQHFNSCGTVNRVTILTDKFGQPKGFAYVEFVEAEAIQEAVKLSESELHGRQIKVAPKRTNVPGLKQPRGGRGFNPYGGHPYMRPYPPPFYNPYGGYGRAPRFRRPRRPFY

SEQ ID NO: 13973 - protein, 363 aa, Lolium perenne
MVQPVFDAALLSGQSDIPSQFIWPADESPSPDATEELHVPLIDIGGLLSGDRAAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEAYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPETLVDEANPRAYPDFTWRALLDFTQKHYRADMKTLEVFSDWIQQGHQPAATTTTT

SEQ ID NO: 13974 - protein, 377 aa, Zea mays
  unsure (1)..(377): unsure at all Xaa locations
MASSSLPAPAAGRAELLKAFDDARTGVRGLVESVVSSVPELFXPRGPLRLASRSPRPAFXIPVVDLSLPPHLAAAAAAAAARTWGFFHLVNHLHALPAAAAAADDDYPERAFAAVRAFNELPAHERAPHYSRAVDGGVNYSSNVDLYNSPAASWRDTIQILLGPNRHPDLADRIPAACRAEVLEWEVRATAVARALLRLLSQGLGLRPEALEDASCADGKLMVCHYYPHCPEPERTMGIVPHTDPGVLTVLAQDGVGGLQVKHQDEDGKISWVDVKPVPGALVINVGDLLQIMSNDEYTSVEHRVVMNTREEPRVSIGIFFSPGKRGDSVFYGPLPELVSSENPPKYRNFTMSEFYGTFFSRDLASKALLDNFKLSP

SEQ ID NO: 13975 - protein, 257 aa, Candida albicans
IIFRKRLDSDRNIDASLYFGNIDPQVTELLMYELFIQFGPVKSINMPKDRILKTHQGYGFVEFKNSADAKYTMEILRGIRLYGKALKLKRIDAKSQSSTNNPNNQTIGTFVQSDLINPNYIDVGAKLFINNLNPLVDESFLMDTFSKFGTLIRNPIIRRDSEGHSLGYGFLTYDDFESSDLCIQKMNNTILMNNKIAISYAFKDSSVDGKKSRHGDQVERKLAESAKKNNLLVTKTSKAGTTKGNKRKNKPHKVTKP

SEQ ID NO: 13976 - protein, 696 aa, Neurospora crassa
MPAQTSFPSLAALRRLQTLNHVYAPLRRTGTGRITNGWTCASCRSQLSASSASSSSSSSSLSVSLYNSTLARRSFSSSSKRSSDQNSNGSSSSSSSSSSSNGNGKTNNNNNNNNNNGRRTVLLAAGGGAAAAGLLAVGDDVKYTYEAVERTGRVASTLAICVNDYRVTLNAREKIEDPEEKQRLLRECHQRCADRTLEVLEKSGGIFIKLGQHLSAMNYLLPPEWTTTFIPLQDKCPVSSFESIERMFLEDTGTSLWDYFSEFSREPIGAASLAQVHLATIKETGQRVAVKVQHPSLQRWAPLDMRLTSTTFKTLKYFFPEYDLEWLSSEVEISLPKELDFTCEAENARRTSRYFAEFAPSLPLVIPDVLWAKKRLLVMACESGHRLDDLAYMDAYGIDRDEVSATLARIFNEMIFGEGAPLHCDPHGGNIAIRYHDNSNKSKSKSNFDIILYDHGLYRDIPLPLRRSYAKLWLAIIDGDIPKMKRYVHEVAGIGEDKFPLFASAITGRDFINVVSATDSGGVLKPKEASEQKSMSTALQEGLIVDLVQMLGQVPRIILLILKTNDLTRALDESLHTKQGPVRQFLILARYCMRTVFYEQLEEIRGLGSIWSPANLVRLVGAWWGMARVEVKLEVFELWLRVKRTLGLGSGFGMGMGTGEEAQQQVVPVGKKGQKRLEREVEAAAAVSVAAAAAAA

SEQ ID NO: 13977 - protein, 325 aa, Thermoproteus tenax
MAEGRCSQGKEPAEAMISLVALGEPLIQLNAVTPGPLRYVAYFEKHVAGSEANFCIAATMAGARCSLIARVGDDEFGRNIVEYLRGRGVDVSHVKVDPGAPTGIYFVQRHFPVPGRSRLIYYRKGSAGSRVGPDDVDSSLISSADAVHSTGITLALSDSANRAVHKAFGEAKRRTFDTNIRPALWPDLAAARRAILDVLNYGVDVLVTDPDDTQILLGVRDPEEAYRKYRELGVQTLVYKLGAEGAYVFWNGGSYFRDALKVAVEDPTGAGDAVAGYFVALYLSGVDPRRALDLAVAASALVVGVRGDNEALPSPREAEELLKAL

SEQ ID NO: 13978 - protein, 383 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLQSPVLSSLLVKAKIMAHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSSLGYGEAAIERNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPLHYFMGNVLGNPFPIDHISGTML

SEQ ID NO: 13979 - protein, 344 aa, Solanum tuberosum
MRTSMLRTLARRTSTAGTRRGFASESAPDRKVAILGAAGGIGQPLSLLMKLNPLVSRLALYDIAGTPGVAADVSHINTRSEILGYAGEEQLGKALEGADVVIIPAGVPRKPGMTRDDLFNINAGIVKSLCTAIAKYCPHALVNVISNPVNSTVPIASEVFKKAGTYDEKRLFGVTTLDVVRAKTFYAGKAKVNVADVIVPVVGGHAGVTILPLFSQATPSANLSSEEIEALTKRTQDGGTEVVEAKAGKGSATLSMAYAGAIFADCLLEWDLNGVPGCLYSCHSYSQLVTEPAISLHPRLRFGKNGVEEVLGLGALSDYEKEGLEALKPELKSSIEKGIKFANA

SEQ ID NO: 13980 - protein, 67 aa, Zea mays
  unsure (1)..(67): unsure at all Xaa locations
FKKVSNFLARFKSLPRIVXLSSFKVFGDVWFGFGISLKGKVPIFPQPGVKFEIPNGDVLXNKDVHGP

SEQ ID NO: 13981 - protein, 466 aa, Aureoumbra lagunensis
YAKMGYWDSSYTIKTTDLLALFRITPQPGVDPVEAAAAVAGESSTATWTVVWTDLLTACDVYRAKAYRVDPVPSAADQFFAYIAYEGDLFEEGSLANMTASIIGNVFGFKAVKALRLEDMRIPHSYLKTFQGPATGVIVERERLDTFGRPLLGATVKPKLGLSGKNYGRVVFEGLKGGLDFLKDDENINSQPFMRWRERFLYCIEGINRAVSVTGEVKGSYLNITAGTMEEMYTRAEYAKELGSIIVMIDLVIGYTAIQSMAIWARNNDMVLHLHRAGNSTYARQKTHGINFRVICKWMRMAGVDHIHAGTVVGKLEGDPLMVQGFYDTLLLTHLKIDLPKGIFFDMDWASLRKCMPVASGGIHCGQMHQLLNYLGDDVVLQFGGGTIGHPDGIQAGATANRVALEAMVLARNEGRNYVEEGPQILRDTAKMCGPLQTALDLWKDISFNYASTDTADFVETATANV

SEQ ID NO: 13982 - protein, 348 aa, Rhodococcus erythropolis
MKAIQYTRIGAEPELTEIPKPEPGPGEVLLEVTAAGVCHSDDFIMSLPEEQYTYGLPLTLGHEGAGKVAAVGEGVEGLDIGTNVVVYGPWGCGNCWHCSQGLENYCSRAQELGINPPGLGAPGALAEFMIVDSPRHLVPIGDLDPVKTVPLTDAGLTPYHAIKRSLPKLRGGSYAVVIGTGGLGHVAIQLLRHLSAATVIALDVSADKLELATKVGAHEVVLSDKDAAENVRKITGSQGAALVLDFVGYQPTIDTAMAVAGVGSDVTIVGIGDGQAHAKVGFFQSPYEASVTVPYWGARNELIELIDLAHAGIFDIAVETFSLDNGAEAYRRLAAGTLSGRAVVVPGL

SEQ ID NO: 13983 - protein, 176 aa, Zea mays
  unsure (1)..(176): unsure at all Xaa locations
RPADFVVAPPFIYIDQVKNSLTGRIEVSAQNVWIGKXGAYTGEISAEQLVDIGCQWVILGHSERXHIIGENDEFIGKKAAYALSQNVKVIACIGELLEEREACKTFDVCFRQKKAFADSISNWADVVIAYEPVWAIGTRKVATPEQAQEVHAPVRNWLKTNISHDVASSTRIIYGG

SEQ ID NO: 13984 - protein, 477 aa, Myriogramme smithii
KNDRYESGVIPYAKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKDLGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 13985 - protein, 335 aa, Clostridium tetani E88
MVKVAINGFGRIGRNVFKVLIEKYSSELEIVGINDLTDAKTLAHLLKYDSLYGKFNGTVEAKENAIAINGKEIKIFAERDPKNLPWKEEGVDIVLECTGLFTDATKAKAHIEAGAKKVIISAPAKNEDVTIVLGVNEEKYNSEEHNIISNASCTTNCLAPFAKVLDQEFGIVEGLMTTIHSYTNDQKILDAPHKDLRRARAAAESMIPTTTGAAKAVALVLPQLKGKLNGMAVRVPTPTVSMTDLVCTISKEATAEEINAAFKKASETDMKGILGYSEEPLVSVDYRGDARSSIVDGLSTMVMGNRLVKVVSWYDNEWGYSTRLADLAKYVADRL

SEQ ID NO: 13986 - protein, 394 aa, Zea mays subsp. mays
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 13987 - protein, 236 aa, Zea mays
  unsure (1)..(236): unsure at all Xaa locations
MLLLLFFAVLAAVAAFLLFKFATVVDGVTPISFFNPTMPSFLSLSVLLFAPVGLGRLGLTPCSLMAVGDLTLVSRGPPLRERVDSKVVWITGASRGIGSARDSASKHALNGYFASLRSELCTKGIKVTVICPGPIETLQSSAAASSSQTHSAEQKREKRVSVERCVELTIVAATHGLKEAWISYQPVXLTVMYLVQYMPTIGYWLMDKVGAKRLDAAAKKGNTYSWSLIFSSKKSA

SEQ ID NO: 13988 - protein, 248 aa, GIBBERELLA ZEAE PH-1
MATEEKPQHLEPSKLGTKQYWDDLYTNEISNHSADPSDIGTVWFDDSDAEAKILEFLDGLLDPSDPDSPVLSHDKSTFLDLGCGNGSLLFSLRGEDWSARALGVDYSPQSIALARQITATKDDLEEPVEFEEWDLIAGSYDPVLNGEQAQGWDVVLDKGTFDAISLSGEKDTQGRRLCECYRERVLPLVRKGGIFLVTSCNWTETELKGWFEKTDAEGFEVVGKVEYRSFSFGGHKGQTISTLCFRRV

SEQ ID NO: 13989 - protein, 427 aa, Coxiella burnetii
MTELTGVSIVTYQHIKVPSEGEKITVNKAVLEVPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSASQFAKAIIKHIL

SEQ ID NO: 13990 - protein, 679 aa, Bacillus agaradhaerens
QQATDRSNSVNYSTDVIYQIVTDRFYDGDESNNPSGELYSEDCKNLRKYCGGDWQGIIDKIDDGYLTNMGVTALWISPPVENIFETIDDEFGTTSYHGYWARDYKKTNPFFGSTEDFERLIETAHSHDIKIVIDLAPNHTSPADFDNPDYAENGVLYDDGNYLGSYSDDSDLFLYNGGTDFSNYEDEIYRNLFDLASFNHINSELNNYLEDAVKKWLDLGIDGIRIDAVAHMPPGWQKAYMDTIYDHRAVFTFGEWFTGPSGNEDYTKFANNSGMSVLDFRFAQTTRNVIGNNNGTMYDIEKMLTDTENDYDRPQDQVTFLDNHDMSRFTNGGESTRTTDIGLALMLTSRGVPTIYYGTEQYMEGDGDPGSRGMMASFDENTDAYKLIQKLAPLRKSNPAYGYGTTTERWINDDVLIYERHFGENYALIAINRNLNTSYNIQGLQTEMPSNSYDDVLDGLLDGQSIVVDNKGGVNEFQMSPGEVSVWEFEAENVDKPSIGQVGPIIGEAGRTVTISGEGFGSSQGTVHFGSTSAEILSWNDTIITLTVPNNEAGYHDITVVTEDEQVSNAYEFEVLTADQVTVRFIIDNAETKLGENVFLVGNVHELGNWDPEQSVGRFFNQIVYQYPTWYYDVNVPANTDLEFKFIKIDQDNNVTWQSGANQTYSSPESGTGIIRVDW

SEQ ID NO: 13991 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAGKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 13992 - protein, 546 aa, Zea mays
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 13993 - protein, 287 aa, Arabidopsis thaliana
MAKLRHSRFQARKWSTLMLVLFMLFMLTIVLLMLLAFGVFSLPINNDESSPIDLSYFRRAATERSEGLGKRGDQWTEVLSWEPRAFVYHNFLSKEECEYLISLAKPHMVKSTVVDSETGKSKDSRVRTSSGTFLRRGRDKIIKTIEKRIADYTFIPADHGEGLQVLHYEAGQKYEPHYDYFVDEFNTKNGGQRMATMLMYLSDVEEGGETVFPAANMNFSSVPWYNELSECGKKGLSVKPRMGDALLFWSMRPDATLDPTSLHGGCPVIRGNKWSSTKWIHVGEYKI

SEQ ID NO: 13994 - protein, 757 aa, Bacteroides thetaiotaomicron VPI-5482
MSQLPTLIADLALILICAGVMTLLFKKLKQPLVLGYVVAGFLASPHMPYTPSVMDTANIKTWADIGVIFLLFALGLEFSFKKIVKVGGSAIIAACTIIFCMILLGIGVGMGFGWHRMDSLFLGGMIAMSSTTIIYKAFDDLGLRKKQFTGLVLSILILEDILAIVLMVMLSTMAVSHNFEGTEMLESIGKLLFFLILWFVVGIYLIPEFLKRCRKLMGEETLLIVSLALCFGMVVMAANTGFSAAFGAFIMGSILAETIEAESIDRLVKPVKDLFGAIFFVSVGMMVDPAMIIEYAIPIIVITIAVILGQATFGTFGVILSGKPLKTAMQCGFSLTQIGEFAFIIASLGVSLHVTSDFLYPIVVAVSVITTFLTPYMIRLAEPASSFVDAHLPASWRKFLMRYSSGSQTVLNHENLWKKLLLAMVRITVVYSIVSISIIALSFRFVVPFFKENLPHFWASLLGAVFIILCISPFLRAIMVKKNHSVEFMTLWHDNRANRAPLVSTIVIRIMIAALFVIFVISGLFKASIGLIIGVAVLAVLLMVWSRRLKKQSILIERRFFQNLRSREVRAEYLGEKKPEYAGRLLSHDLHLADLEIPGESTWAGKTLMELNLGKKYGIHIASILRGKRRINIPGGSVRLFPMDKIQVIGTDEQLNVFSSAMQSGAKIDWEMYEKGEMTLKQFIIDADSVFLGKTIRESGIRDKYHCMIAGVEREDGTLMVPDVNAPFEEGDVVWVVGEKENVYQLVDQKNEKIQVK

SEQ ID NO: 13995 - protein, 93 aa, Glycine max
  unsure (1)..(93): unsure at all Xaa locations
NSKKSTVDVELSSLGGGMNISRHHARIFYDYAXRRFALEVLGKNGCLVEGVLHLPGIPPVKLDSQDLLQIGDKDFYLLLLVRSILIRPVGTRH

SEQ ID NO: 13996 - protein, 809 aa, ASPERGILLUS NIDULANS FGSC A4
MYFLLSVIFHFPVFCAGFPPAVSREISTTLLTKLTLMSQYSAASGCSENNNSSVGSSVYCGAEMCPLIDSANTELLYAFSEIYPGDTAGYIAADHTNALLIISFRNSVTPTNFITDWAFLQVSAPTACSGCRAHKGFWSAAVAADKALDGSIREAKARYPEYELTLTGHSLGGALATLHAIFLRNRGVAVDSYTFGAPSVGDYAMADYITNGPGSDNGRNYRVTHLNDVFPKMLYRASRMPVADRLVQEYSQSGPEYWITSGFGEPVTTADVHILEGVDNEQGNLGREPGSLRDHMWLTLIFVIFCWRRSHYLICVMRGTYKNGQETPPTATTISVVNPATEEALATINATPSEAVDEIITASWKTFHSGVWSRKDPSDRFAVLSRASTLLRGRINDFVALETVQTGRPIREMRTQLARVPEWLDYFASLARVHEGRVTPFKGAVTNTLTRIPLGVVVLITPYNHPLLIAMKKIAAALAAGNVVIVKPSELAPLSVLKLGALFKEAGLPDGVLQIVSGYGRETGKYLCEHPKISKIDLTGGIATYRAIAPVAAMNMIPITAELGGKAPVCIFPSTDVETAVKAALFAGFIASGQTCVTGSRILVHKDIYDSFRSLLEKRVRALRVGDPTDEKTQIGSVISAAAIERCEAFVSRATAEGGTILCGGTRLTPTPEKKGYFFAPTVIETASTSDLANNEVFGPVLALIKCSDEDEIVRIANGTSYALGASVWSNDFTQAHSVADKIEAGIVWINGHHLNDPSSPWGGFKESGVGKENGVEAYESYTKVKSTVMNYGVKPVWFDDEVADARYG

SEQ ID NO: 13997 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 13998 - protein, 304 aa, Burkholderia fungorum
MNYASILEQIHGDLQPYLGSGKVADYIPELARVPADSFGMAIVTASGEVFRTGEADTRFSIQSISKLFACTMAFRLLGDALWQRVGREPSGNAFNSLVQLEAEQGKPRNPFINAGALVVTDVLCRRFVQAETALVEFMRRLTGEAGIDYDSRVAQSELQHAHRNRAMAHFMASFGNMEMPPEVVVDAYCRQCAISMSCVELAKAALFLTNHGVVPATGERILDTSSAKRLSALMLTCGTYDAAGDFVYRVGLPAKSGVGGGIVAVLPGEMAVCVWSPGLDSNGNSLAGVLALEWLTTCTGQSIF

SEQ ID NO: 13999 - protein, 519 aa, Caulobacter crescentus CB15
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 14000 - protein, 473 aa, Oryza sativa
MDWDLKMPVSWDLAELEHNAVPNMAAAASAAEPGIAAVAASRGAPGRPECSVDLKLGGLGEFGAADALKEPAAAAKAPVSSAAAAASVAKVPPSTSTLKRPHDGGSGGGGQCPSCAVDGCKADLSKHRDYHRRHKVCEPHSKTPVVVVSGREMRFCQQCSRFHLLGEFDEAKRSCRKRLDGHNRRRRKPQADSMSSGSFMTSQQGTRFASFTPPRPEPSWPGIIKSEETPYYSHHHHPHPVMTSRQPHFVGSPSSATTAAFSPKEGRRFPFLHEGDQISFGGGGGAAAAATLEISVCQTTVVAPPPPESSSSNKMFSSDGLTTATTTTTTAHHHHHHHQVLDSDCALSLLSSPANSSSVDVSRMVQPSPAAAAGAEHHHHHQIPMAQPLVPNLQQQFGGSSPWFASSPAAAAVAGGGFACPSMDSEQAAAAAAERRAGAGLQRERDELPRHVSRRRRGLLRRHVAVAPILVAV

SEQ ID NO: 14001 - protein, 367 aa, Campylobacter jejuni subsp. jejuni NCTC 11168
MQANKNIQKLTPYLSIPHKIWNSSQSNILKLDWNEATIPPSPYVIESIKKFLVNGNLNWYPNTKNLYLLDKIAEYTKQINSSFVELFEGSDSAHECIIDVFLDKCDKIGIVSPTYDNFRSRANGVGIETISFTLDDNFNLDFDSLEYFIHEKRIKLLYLCNPNNPTGKSYNIQKIKSLIINNPNVMFIIDEAYYEFTSQSVCDLVEQCNNLIITRTFSKAFALASFRIGYIISHPENIESINKLRNPKSVPMLSQIAANAALEDLQYMRDYVDEVSCARMEFVKFLNTLTTGGGGIFNDSVANFVLIQNENISLFVGFLEKEGIFIRNYSHLISKNCRISIGTRNQMSYVAEKIQEFAKKQGGFHLV

SEQ ID NO: 14002 - protein, 196 aa, Triticum aestivum
  unsure (1)..(196): unsure at all Xaa locations
GRXGWSSLGGIVLCITGAEAMFADLGHFSKLSLRLGFTIVVYPCLVLAYMGEAAYLSKHREDLQSSFYKALPDRVFWPVLFIATLATAVGSQAIISATFSIISQCRALGCFPRIKVVHTSSHVHGQIYIPEVNWTLMSLCLAVTIGFRDTEMIGNAYGLAVILVMFATTCLMFLVITTVWNRSVLWAALFAAGFGS

SEQ ID NO: 14003 - protein, 363 aa, Vibrio parahaemolyticus RIMD 2210633
MTDKSYKIAVLPGDGIGPEVMAQAHKVLDAIEQKHGISFEREEHDVGGIAIDNHGCPLPESTVTACEESDAVLFGSVGGPKWEHLPPNDQPERGALLPLRKHFQLFCNLRPAQIHAGLEAFSPLRADISGRGFDIVVVRELTGGIYFGQPKGREGEGANEKAFDTEVYHRYEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIESAVSKALSAGELTADLASDKPALTTSEMGDKIAEYILNS

SEQ ID NO: 14004 - protein, 459 aa, Emiliania huxleyi
DPEYVIKDTDILALFRCTPQPGVDPVEAAAALAGESSTATWTVVWTDLLTACDLYRAKAFRVDPVPSAADTYFCYIAYDIDLFEEGSLANLTASIIGNIFGFKAVKALRLEDMRFPVALLKTYQGPATGVVVERERMDKFGRPLLGATVKPKLGLSGKNYGRVVFEGLKGGLDFLKDDENINSQPFMRYRERFLYSMEGVNHAACLTGEVKGHYLNTTAATMEDMYERANFARDLGSVIVMIDLVIGYTAIQSMGKWSRDNDVILHLHRAGNSTYSRQKNHGMNFRVICKWMRMSGCDHIHAGTVVGKLEGDPLMIKGFYNTLLDTKTEVNLPQGLFFAQDWASLRKCVPVASGGIHCGQMHQLINYLGDDVVLQFGGGTIGHPDGIQAGATANRVALECMVLARNEGRDYIAEGPQILRDAAKTCGPLQTALDLWKDITFNYASTDTADFVETATANV

SEQ ID NO: 14005 - protein, 310 aa, Staphylococcus epidermidis
GFGRIGRLAFRRIQDVEGLEVVAVNDLTDDDMLAHLLKYDTMQGRFTGEVEVIDGGFRVNGKEVKSFDEPDASKLPWKDLDIDVVLECTGFYTDKDKAQAHVDAGAKKVLISAPATGDLKTIVYNTNHDELDGSETVVSGASCTTNSLAPVAKVLSDEFGLVEGLMTTIHAYTGDQNTQDAPHRRGDKRRARAAAENIIPNSTGAAKAIGKVIPEIDGKLDGGAQRVPVATGSLTELTVVLEKDVTVEQVNEAMKQASDESFGYTEDEIVSSDVVGMTYGSLFDATQTRVMAVGGRQLVKVAAWYDNEMS

SEQ ID NO: 14006 - protein, 158 aa, Glycine max
MDMRLMDLDSPFFNTLHRIMDLTEDAEKNLNAPTRTYVRDAKAMAATPADVKEYPNSYVFVIDMPGLKSGDIKVQVEDDNVLLISGERKREEEKEKEGGKYLRMERRLGKLMRKFTLPENANTDAISAVCQDGVLTVTVNKLPPPQPKKPKTIEVNIA

SEQ ID NO: 14007 - protein, 338 aa, Prochlorococcus marinus subsp. pastoris str. CCMP1378
MIEKNNLFDLKKDIDLIGLGNAIVDIIVNVDDEFLEINTLKKGSMNLINSNESEALLKNCTVIKKISGGSSANTVVCLAELDNNVQFIGRVKNDNFGNFFSTDIKRSNTIFNTPPIDKGPSSAHSIIFITPDAQRTMCTYLGASIEFEPKDVNYKLIANSKYLYLEGYLWDSDLAKNAFLQAAKLAKESDTKIILSLSDSFCVDRHRESFLELIENYIDIVFCNESEVLSLFQENDLQRCQESISSICELVIITLGSKGSLVVNKDKSEEIKPKLLGKIIDTTGAGDLYAGGFIHGLINNYSLKKCGEIGSICAGQIITQLGSRSNINLQNLLRKHLI

SEQ ID NO: 14008 - protein, 210 aa, Papaver somniferum
SVLCDAEVALIVFSTKGKLFEYSTDACMDAILERYERQCCVEEELVGTDQESQGNWSLEHAKLKAKVEVLQRTQRHMMGEDLESFNVKELQNLEHQLDTSLKHIRSKKNQLLYASISELQRKEKALQEQNTILGKKIKEKEQEMGRLDQQQQSNQAQNSCSQAQNSAQNSPTFLLSQELPSLTICTGTYEPAARPIAIQTVMPPWMLRHL

SEQ ID NO: 14009 - protein, 274 aa, Zea mays
  unsure (1)..(274): unsure at all Xaa locations
MVSLRFPTAAIPRLPPSQAPNGVAIAATVAAAAAAAAAVAASXDPHGQVHWPASXHPAPLWASLSLADAAAPSSVEPRTGATFPTEAAVGRRLLGIGLRKTSVLGLKSIDVYAFGVYADDNDLKQQLKEKYSKFSVSELKGNGELINDALERDIPMTVRLQIVYGRLSIRSVRSAFEKSVGSRLQKFGGQDTKELLQSFVAVFKDEYKLPKGSVIELSRESNHVLKICIEGEEVGSIQSKLLCKSLLDLYIGDDSFDENAKDGIHENIASILKS

SEQ ID NO: 14010 - protein, 221 aa, Glycine max
MSNVFEGYERQYCELSANLAKKCTAAGVLNGEQKKQKVSEVKAGIDEAEALIRKMDLEARSLQPNIKGVLLAKLREYKSDLNNLKSEVKKIVSGNLNPSARDELLESGMADAMTASADQRTRLMVSTERLNKTSDRVKDSRRTMLETEELGVSILQDLHSQRQSLLHAHNTLHGVDDNIGKSKKILTNMSRRMNKNKWVIGGIVLVLIIAIIVILYFKLSK

SEQ ID NO: 14011 - protein, 441 aa, Zea mays
  unsure (1)..(441): unsure at all Xaa locations
MAAASFTAAKFLAPVAARSGGEXRPPPSRTLRRGPPLPAGASSSSFARTLRRGAVHHPRLRTALAVSSDLLAGNKAAQAAAAHPAVTREEALELYEDMVLGRVFEDMCAQMYYRGKMFGFVHLYNGQEAVSTGFIKLLNQADCVVSTYRDHVHALSKGVPARSVMAELFGKATGCCRGQGGSMHMFSAPHNLLGGFAFIGEGIPVATGAAFAAKYRHEVLKESGPDGLDVTLAFFGDGTCNNGQXFECLNMAQLWKLPIVFVVENNLWAIGMSHIRATSDPEIWKKGPAFGMPGVHVDGMDVXLKVREVAKEAIERARRGEGPTXLVECETYRFRGHSLADPDELRKPDEKTHYAARDSITALKKYIIEQNLATESELKSIEKKIDDVVEEAVEFADAEPXPPRSQLLENVFADPKGFGIGXPDGKYRCEDPKFTQGTAQV

SEQ ID NO: 14012 - protein, 112 aa, Glycine max
  unsure (1)..(112): unsure at all Xaa locations
TTVNRAGAGMADPLTALXSMAVCPTXNTIIDFTSFASNAGRAQYMQMWPPVGYKKFETLSYLPDLDDAHLGKDGEYLLRTGWSPRXEFELEHGFLCREHNRAPEYYDGRYWT

SEQ ID NO: 14013 - protein, 241 aa, Nicotiana sylvestris
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLTDLQRKEHALNEANRTLKQRLMEGSQLNLQWQQNAQDMGYGRQTTQTQGDGFFHPLECEPTLQIGYQNDPITVGGAGPSVNNYMAGWLP

SEQ ID NO: 14014 - protein, 488 aa, Sphaerotrichia divaricata
  unsure (1)..(488): unsure at all Xaa locations
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGXXXXXRAATTCGPLKAALDLWKDITFDYTSTDTPDFVEVATESR

SEQ ID NO: 14015 - protein, 249 aa, Xylella fastidiosa Dixon
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 14016 - protein, 372 aa, Zea mays
MSSVQEELNNTQDMLQGYVELYNYSLSYVKTMAIGCAIQLGIPSAIHRRGGAATISDIITETGVDPSKLPYLRRLMRVLTVSSILATTGTDETETESDDSTVYKLTPASRLLVSGAGAPTSCDISPMLDLLMRPTTSVATYFSLEEWFKDAGATATLFEVAHGMSPWSLTKNDALYNKTLNDGCAADSNFAMDTLLREPRAAGIFRGLGSLVDVGGGHGAAAMAIARAFPHIRCSVLDLEQVVSGAPDDGTVKFIAGDMFESIPAADCVLLKYVLHCWDDESSVKILRQCKRAIPARDAGGKVVIMNMVVGYGSSDRFVKETQVMCDMWMMRYVGVEREEHEWKRIFLEAGFSDYRITPTALGFQSVIEVFP

SEQ ID NO: 14017 - protein, 245 aa, Zea mays
AVPEGRRPQVVTFGVPEEDSGGRYESSEMDGGHDAASAEQHVAVTRPAERKGRTCCRRCGKSKWESKESCIVCDARYCGHCLLRAMGSMPEGRKCVTCIGQPIDEAKRSRLGKGSRILSRLLGPLEVRQILKVEKECQANQLRPEQLLVNGFPLDDEEMTDLLSCQRPPGNLKPGRYWYDKESGLWGKVILVGLRKPVSCNLSFSSDQKKKMSPGNQAAGNNWGTIIIPLNRTARVGRVFCPKTQ

SEQ ID NO: 14018 - protein, 363 aa, Buchnera aphidicola (Uroleucon aeneum)
MTRKYRIAVLPGDGIGPEVMREAYKILNILKDDFSLPLEIKEFNIGGAAIDQEGVALPKKTLLGCENSDAILFGSVGGKKWDNLPINQRPERASLLPLRKHFNLFANLRPAQLYSELKNLSPLRSNIIKNGFNILCIRELTGGIYFGKPTGRLKKNNIEYAFDTEIYYNYEINRIAHLAFQLSQTRNYKVCSIDKSNVLNSSILWREIVKKVSKHYPDVHLSHLYIDNATMQIIKDPNQFDVLLCSNLFGDIISDECAMITGSIGMLPSASLNEKKFGLYEPAGGSAPDIEGKNIANPIAQILSLSMLVRYSMNLKKIADKIDQSVISVLKKGYRTADISNNNDYLKTNEMGDVIASALISGE

SEQ ID NO: 14019 - protein, 839 aa, Oryza sativa
  unsure (1)..(839): unsure at all Xaa locations
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSYPPHIAAYRSGLEIDPNISKTDAEDGLRKELSGQRPLRITNKNLIDYLFTCSLEIVVSYHLPMQIXTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKWNVANGSSRSXITAIADNGIPLSEQDVLFVRVVWIDTSGQHRCRVVPAGRLDEIARKKGIGLTFASMGMTSFTDGPADGTNLTGVGEIRLMPDMSTLLARPXREDMVMAEMHITPGEAWEYCPRNTLRKATKVLLDEFNVTMMAGFENEFFLRKKVVSGXEKELWVPFDNTPYCSTTAFDGASSVLQEVYTSLKAAEIVVEQLHAEAGKGQFEIALKYVLCTLAADKLIYAREIIKSVARKHGLLATFLAKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 14020 - protein, 159 aa, Zea mays
MAAAAAAPASVVPSPSPAPKASDSRKTVVPVDASELEKHVLAVDDSSVDRAVIARILRGSRYKVTAVESATRALELLALGLLPDVSMIITDYWMPGMTGYELLKRVKESAALRGIPVVIMSSENVPTRITRLPGGRGAEGFLLKPVRPADVSRLCSRIR

SEQ ID NO: 14021 - protein, 292 aa, Oryza sativa
MISSRKLAQLAKKWQMMVASSGRQTANIDGCCSTATVYVADKGHCVLYTTDGARFEVPLMYLNTVVFCELLRMSQEEFGFTSDYKITLPYDAAVMELRNGTDPEIWTQATCGPHEACVLDTKTGQYSHTMWCPYIHELFLWQERRRATMISAKRLAQMAKKWQRIAALGRKRITWTTPKATDECCSSVAVKGHCIMYTADGRRFEVPLAFLATTIFAELLRMSQEEFGFTTDGGITLPCDAEVMEYVLCLLRRNASEEVVRAFLSTIVKSCHYGNGFAQSLGSVQQVAASSF

SEQ ID NO: 14022 - protein, 503 aa, Schizosaccharomyces pombe
MTLDQVRIPFLVEQTYPIIVPSYAGWFDMSKIHDIERRSNPEFFNGKSPLKTPSIYKDYRDFMINSYRLEPNEYLTVTACRRNLVGDVCAIIRVHAFLEQWGLINYQIDPETRPAFRLPPISGHVQAISNTPIVTQEMLAQHPPPSTVGGSSSQEFVKLEEKHYSPSLNAMEQTSPKEEDEKSDKVPRVDKVCFTCGVNCSQTWYHNLKNKKYDICPNCYKQGRFSSSFNSSDFLCMDAIDFNHDEEKPWSNQETLLLLEAIETYGDDWNQIALHVGSRTKEQCLIHFLQIPIEDPYRQKLQGDFSPFKKGFLPFDENENPVLSTLTYLASIVQQGMKERKQNESVKQGETSFGNSEFKNPLERVAYYALKSAAQKAKLIAAFENRQLRRLVFSLIQAQLEKLQLKMKVLEQLEKMCSLELSELDLRGKNLLLSRLSTKKMLLAFNKKLEEAVNLGGEDGLKIIDDLMSTEHAEALLTFEMPTATTVSPLSKQYPDKFRTIAL

SEQ ID NO: 14023 - protein, 440 aa, Cladosporium herbarum
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSAAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 14024 - protein, 314 aa, Rumex palustris
MEFPIINLEKVNGDERKATMDMIKDACENWGFFELVNHGIPVEVMDTVERLTKEHYKKSMEQRFKELVASNGLVNASAEVNDVDWECTFHLKHLPDSNISELPDLEEEYRKVMKDFALRLEKLAEDLLDLLCENLGLEKGYLKKAFYGARGPTFGTKVANYPPCPKPELIKGLRAHTDAGGIILLFQDDRVSGLQLLKDDEWIDVPPMPHSIVVNLGDQLEVITNGKYKSVLHRVIAQTDGTRMSIASFYNPGSDAVIYPAPELVEEAQEKTQVYPKFVFEDYMKLYSALKFQAKEPRFEAMKAVSTWDPIATA

SEQ ID NO: 14025 - protein, 168 aa, Zea mays
MAATIQSVKARQIFDSRGNPTVEVDVFCSDGTFARAAVPSGASTGVYEALELRDGGSDYLGKGVSKAVNNVNSVIGPALIGMDPTAQTEIDNFMVQQLDGTKNEWGWCKQKLGANAILAVTLAVCKAGASIKRIALYQHIVNLAGNKQIVLPVPAFNVINGGSHAGYK

SEQ ID NO: 14026 - protein, 493 aa, Pseudomonas syringae pv. syringae B728a
MSASDGTPLLQRAIEAECVFNGDWIPSSSPSLPVIEPATGELLMNTAMADAADIAVACREAALAQPAWAALGPREKADIFLLAADHAVCAFDELALYVARETGGSLHKGQHEVNETIVLLRQAAGMLSQAHGHGLILPSQAGRLSYARRVAHGVVGVISPFNFPLVLSLRSVAPALAAGNAVVLKPDPQTPISGGFLIARLFEEAGLPKGLLHVLPGSADAGEALCRDTNVQMITFTGSTGAGRKVAEAAGRNLKKVSLELGGKNPLVILEDADLDLAASNAAFGAWLHQGQICMATGLILVHESIVADLTRKLADKARALTVGNAARGEAALGPLINKRQLQHVHQVVSDSLQAGARLETGGEYEGLFYRPTVLSGVKPGMRAFDEEIFGPVAVVVSFSTDEEAIELANRSEYGLAAAVISPDVGRATAIGDRLKCGMLHINDQTVADECVNSFGGRGASGNGSSAGSPSDWDEYSQWQWVTVKNQAPAYPF

SEQ ID NO: 14027 - protein, 159 aa, Glycine max; identical to SEQ ID NO: 9734

SEQ ID NO: 14028 - protein, 340 aa, Streptomyces avermitilis MA-4680
MSTYRAAQVAAASGPFEIVQREVPRPGPGHVRIAVDACGICHSDSVFVDALLPGVRFPLVPGHEIAGHIDELGEGTDISWQVGDRVAVGWFGGSCGHCPPCRQGDFVVCQNLKVPGWAYDGGYAEAVIAPADALARIPDALAATDAAPLGCAGVTTYNGLRRSSARPGDLVAVLGIGGLGHLGVKYAAAMGFETVAIARGSDKADFAKQLGAHHYIDSTADTTVADALQSLGGAKAVLATAANSDAITATVDGLAPRGELVAIGVDAEPLGISPNQLLMGGKIIRGHPSGTAQDVQDTMAFSALHGIRPMTETVPLDQADEAYRKMMSGAARFRMVLTTG

SEQ ID NO: 14029 - protein, 435 aa, Bacillus cereus ATCC 14579
MERRVPITVEEAVRKVMGFADKGLKELLPIELAYGRILAEDLVADHDVPSFNRSPYDGFAIRAEDTNLASYETPIVFEVVGEIGAGSLFHEKVGPFQAVRIMTGAQIPNGCDAVVMLELTRQYEKNGNNYMEVKRSFKTGDNISFQGEDARKGTVLAKKGSYINPGISALLATFGYSEVPVARKPVIGLLATGSELLDVNDSLQPGKIRNSNTYMILSQIRRAGGRVKYFGKFSDDFNTCFTAVKEALGQVDMLITTGGVSVGDYDYLPAIYEKLGASVLFNKVAMRPGSVTTVAQLNGKLLFGLSGNPSACYVGFELFVRPCIRTYMFSEKVHLKREKALLGEDFLKPNPFTRFVRAKLQYDEGKLIAYPSGFDKSSSVSSLAESNAFIVLPGGTRGYKKDMFVDVLLLEDNEGSEWPWTFHKVRGGFNGTSAI

SEQ ID NO: 14030 - protein, 159 aa, Glycine max; identical to SEQ ID NO: 9734

SEQ ID NO: 14031 - protein, 183 aa, Zea mays
  unsure (1)..(183): unsure at all Xaa locations
MEGSSVVAVYGNGAITEAKKSPFSVKVGLAQMLRGGVIMDVVNAEQARIAEEAGACAVMALERVPADIRAQGGVARMSDPQMIKDIKQAVTIPVMAKTRIGHFVEAQILEAIGIDYIDESEVLTLADEDXHXPQHNFRIPFVWRCPNPRGALGGIREGAXMIRTKGEAGLGHRGSVRTGSLVG

SEQ ID NO: 14032 - protein, 340 aa, Streptomyces avermitilis MA-4680
MPIATPEVYNEMLDRAKAGKFAYPAINVTSTQTLHAALRGFAEAESDGIVQISTGGAEFLGGQYKKDMVTGAVALAEFAHIVAEKYPVTVALHTDHCPKDKLDGYVRPLLAISEERVKAGRNPLFQSHMWDGSAETLADNLAIAQELLEKARAAKIILEVEITPTGGEEDGVTHEINDSLYTTVEDAIRTAEALGLGEKGRYLLAASFGNVHGVYKPGNVVLRPELLKELNEGVAAKFGKADPFDFVFHGGSGSTEAEIRTALENGVVKMNIDTDTQYAFTRPVADHMFRNYDGVLKVDGEVGDKKTYDPRTWGKLAEASMAKRVTEACANLRSTGTKIK

SEQ ID NO: 14033 - protein, 547 aa, Listeria monocytogenes EGD-e
MTLKSGFDYMNNPLLNKGTAFSKEERASYQLDGLLPPIIETIEQQAVRIETQIENLETPLHKHRLLTNLYNENRTLYYYVVTKNVTDYLPIIYTPTIGDAVIQYHKDYTAPDEALFVDAFAPEKLSASIKNYAKNNPNIDMIVITDGEGVLGIGDWSVNGVKIAVGKLAVYTVAAGLAPDRVLPVVIDAGTNNETLLNDPLYLGNKRPRLSESEYDAFIASFVNVMKEVFPKAILHWEDFGRANASRILHNYRDKICTFNDDIQGTGAMVVAAVLATIQVSRIPLSEQKIIIFGAGTAGIGIADQLSAQLMRETGLPFEKAKKHFYLVDRKGLVLDNMTDLTTGQKKYAHPSAEWSNVPTDTLENLVEAVHPTMLIGCSGVTGAFKESIVKKMTQYTERPAILPLSNPTKLAEATASDLIQWTDGKALIVTGSPSKPVEYQNTTYEIGQANNALLYPGLGLGALVTRAKYITDDMLAAASMAVAEQISPNKAGAALLPHVRTLRETSRAVAIAVANQAIKENIHQVELTNVIEAIELEMWQPIYKGV

SEQ ID NO: 14034 - protein, 484 aa, Aspergillus niger
LSAAEWRTQSIYFLLTDRFGRTDNSTTATCDTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQKVLDGVLNYPTYWQLLYAFESSSGSISNLYNMIKSVASDCSDPTLLGNFIENHDNPRFASYTSDYSQAKNVLSYIFLSDGIPIVYAGEEQHYSGGKVPYNREATWLSGYDTSAELYTWIATTNAIRKLAISADSAYITYANDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGRLYVE

SEQ ID NO: 14035 - protein, 509 aa, Solanum tuberosum
MSIVTCEKAAASLSSSSNMNNDTNGAFCYTPQHQLVTPQYQNPPQQIKKKRNQPGNPDPEAEVIALSPKTLVAANRFFCEICNKGFQRDQNLQLHRRGHNLPWKLKKRENKEVVRKKVYICPESSCVHHDPSRALGDLTGIKKHFSRKHGEKKWKCEKCSKRYAVQSDCKAHFKTCGTREYKCECGTIFSRRDSFITHRAFCETLAMESARSVINGRNPTIFSPQLNLQFQQPHFFNSHEQIQATTFPMKKEQQSSDFRHIEIPPWLITTNSQPFQLGAINHGPSPRSNFSSSSIFPATTRLDQQYTQSGHKDLNLHHPNPNLRGPTLGYDSTGESGAVSPVHISATRLLQKAAQFGATISNKASAVTATAAYTGTVKIPHNTHVSVTSTDSATKQTHQKLSSREDLTSITGPANISGIMTSFSNGFDGSTMFEDAILFGGFNNLNSKKEDEEEDQQLYFNGSMNEEDHILTKDFLGLKPLSHTDDIFNIAALVNTEPHHFKNHKTWQS

SEQ ID NO: 14036 - protein, 194 aa, Triticum aestivum
  unsure (1)..(194): unsure at all Xaa locations
MAPTVMASSATSVAPFQGLKSTAGLPVSRRSNGASLGSVSNGGRIRCMQVWPIEGIKKFETLSYLPPLSTEASSKQVXDYLIRPKWVPCLRXSSKVGVIFREXNASPGYYDGRYWTMWXLPISGCTDAXQVINEVEEXKKGXLTVLRRVRQHRKCMRSCLKQRAARSGRLKVIQRAIMHAVPELLVPPLLLVSK

SEQ ID NO: 14037 - protein, 575 aa, Lactococcus lactis subsp. lactis
MKKIKLEKPTSGSQLVLQTLKELGVEIIFGYPGGAMLPLYDAIHNFEGIQHILARHEQGATHEAEGYAKSSGKVGVVVVTSGPGATNAVTGIADAYLDSVPLLVFTGQVGPLSIGKDAFQEADTVGITAPITKYNYQIRETADIPRIVTEAYYLARTGRPGPVEIDLPKDVSTLEVTEINDPSLNLPHYHESEKATDEQLQELLTELSVSKKPVIIAGGGINYSGSVDIFRAFVEKYQIPVVSTLLGLGTLPISHELQLGMAGMHGSYAANMALVEADYIINLGSRFDDRVVSNPAKVAKNAVVAHIDIDAAELGKIVKTDIPILSDLKAALSRLLQLNKVRTDFNDWIKTVTKNKEKAPFTYEPQNHDIRPQETIKLIGEYTQGDAIIVTDVGQHQMWVAQYYPYKNARQLITSGGMGTMGFGIPAAIGAKLAQPNKNVIVFVGDGGFQMTNQELALLNGYGIAIKVVLINNHSLGMVRQWQESFYEERRSQSVFDVEPNFQLLAEAYGIKHVKLDNPKTLADDLKIITEDEPMLIEVLISKSEHVLPMIPAGLHSDEMIGLHFTDENEEVDNA

SEQ ID NO: 14038 - protein, 402 aa, Phaeodactylum tricornutum
MKLSTAALFFIPAVVAFAPPQAAFRSNRALFATETAAEKTTFSKMPASVKPGVVTGKALVDLLQHAKKEGFAIPGVNIVGTNSINACMEAAKKYGGPIMVTFSKGGGQFIAGKAADNSDDAASIAGCVAGAKHVREVAKLYGVPVVLHTDHCQKAWLPWFDGLIEANEEYYKEHGEPLFSSHMLDLSEESLEENIGICKQYMERMAKIDLLLEFELGVTGGEEDGVDNSDVDSSRLYTQPEEVYYAYKELGSVPNAAFTCAASFGNVHGVYAPGNVELKPEILHNTQAYIQEKEGSDDSKPMLFVFHGGSGSDVKDIQYAIEAGVVKMNIDTDTQWAFWDGVREYEATNREYLQGQIGNPDGADKPNKKYYDPRMSLRAGEEAMAARLCQAAEDLKCNGVLN

SEQ ID NO: 14039 - protein, 312 aa, Oryza sativa; identical to SEQ ID NO: 2310

SEQ ID NO: 14040 - protein, 143 aa, Zea mays
  unsure (1)..(143): unsure at all Xaa locations
QHMIIGGLPLLVISVLNHDPALSGHIQDLTWSDILALGYTSIFGSAVSYGVYFYNATRGMIVSFPMLYFHDSLLLSGHITTSLSFLGXSLTTLSSLTFLTPMFASVFGYLYLGETFSTVQIGGALLTLVAIYMVNYKSIIGEK

SEQ ID NO: 14041 - protein, 600 aa, Triticum aestivum
  unsure (1)..(600): unsure at all Xaa locations
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKSNGIQNVLALRXDPPHGQDKFXVKFAGGFSCALDLGGAHLXAKYGDYFGITVAGYPEAHPEVILGEAXLRXEAYSKDLAYLKRKXVDAGAXDVIVTXQLFYDTDIFLKFVNDXCRQIGITCPIVPGIMPINNYKGFVRMTGFCKTKIPAEITAALDPIKDNEEAVKAYGIHLGTEMCKKILASGIKTLHLYTLNMEKTALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSDSPSVGWGGPGGYVYQKAYVEFFCAKEKLGQLIEKSKAFPSLTYIAVNKEGESISNIPANAVNAVTWGVFPGKEIIQPTVVDSASFMVWKDEAFEIWSRGWACLFPEGDSSRELLEQIQKSYYLVSLVDNDYISGDLFAAFKEI

SEQ ID NO: 14042 - protein, 167 aa, Triticum aestivum
SARGEISQRRDGSWYGSWGICFTYATWFAVEGLVSVGRTFKNSAAIRKACEFLLSKELPSGGWGESYLSSHDEVYTNLKGNRPHGTHTAWAMLTLIDAGQAERDPMPLHRAAKVLLNLQLDDGEFPQQEIIGVFLQTAMASYSQHRNVFPIWALTEYRRRVLLAGKK

SEQ ID NO: 14043 - protein, 247 aa, Triticum aestivum
GTRVTSAMAEYALALSTPEGYQGYGPEQGQKSLRKAIADVVYPSMGIRDTEVFISDGAQCDIARLQMMFGRDVTIAVQDPTFPGYVDNGVIMGQTGPAADEESGGSRYAGIEYMRCAPENAFFPDLSRVRRTDVIFFCSPNNPTGHAASRDQLRQLVDFARRNGSIVVFDSAYASYVSPGGGDDKPRSIYEVPGAREVAIEISSFSKFAGFTGVRLGWAVVPDELLYADGTRVARDFDRVVTTCFNG

SEQ ID NO: 14044 - protein, 471 aa, Streptococcus mutans UA159
MMTIFRKKNTNLDKTEMKRHFKVIDLIFLGLGSMVGTGIFTITGIGAAKYAGPALIISIIVSAIAVGISALFYAEFTSRIPANGGAYSYLYATLGEFPAWLAGWYIIMEFLTAISSVASGWGSYFKGLLSSYGIELPSLLNGTFNPAKNNYIDLLPALVIFLVTGIVLLNSKIALRFNSSLVVMKFSALALFIIIGLFYIKPENWSNFAPFGFGKIYGGQTGIMAGASLMFFAFLGFESISMAVDEVQKPQKNIPKGIIASLTIVTILYVSVTLVLTGIVHYSKLNVADAVAFALRQAGLVWAANYISVVAILTLITVCISMTFALARTVYSISRDGLLPKQLGIVTKHSKVPKNATLLVGFASMICAGVFPLSSIAEFLNICTLAYLIMLAIAIIKLRKDQGQPKIGEFKTPFIPFLPIVSIVICLSLMSQYKSVTWIAFGISTSIGFLIYFAYGYRHSTIFIKNNPKIR

SEQ ID NO: 14045 - protein, 331 aa, Methanosarcina acetivorans C2A
MKLAVIEGDGIGREVIPAAVEVLDAFGLELEKVSLELGYARWERTGSAISEEDIATIKGCDAVLFGAVTTVPDPSYKSVLLTIRKELDLYANVRPVKPLPGITGVTGRNDFDFIIVRENTEGLYSGIEEIGPDLSWTKRVVTRKGSERVAEYACKLAKQRKNKLTIVHKSNVLKSDKLFLDVCRQVASSHGVEYGDMLVDSMAYSLMMRPDKYDVVVTTNIFGDILSDMCAALVGSLGLVPSANIGEKYAFFEPVHGSAPDIAGKGIANPLAAILCVKMLLEWSGRGKEAALIDRAISYILEKKLITPDLGGVSTTAEVGQTVAKYVMQNL

SEQ ID NO: 14046 - protein, 338 aa, Glycine max
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 14047 - protein, 473 aa, Triticum aestivum
  unsure (1)..(473): unsure at all Xaa locations
MAAAAVAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQXGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 14048 - protein, 154 aa, Zea mays; identical to SEQ ID NO: 13591

SEQ ID NO: 14049 - protein, 386 aa, Zea mays
  unsure (1)..(386): unsure at all Xaa locations
MGKIKIGINGFGRIGRLVARVVLQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKXVINNLFVLITTQFISKPLSEGNKHPLLDXSPLPHVQCLCLVMLAVDYRAASEGPLKGIMGYADEDLVSTDFLGDSRSSIFDAKAGIALNDHFVKLVSWYDNEWGYSNRVVDLIRHMFKTQ

SEQ ID NO: 14050 - protein, 252 aa, Triticum aestivum
MGRGRVELKRIENKINRQVTFAKRRNGLLKKAYELSVLCDAEVALIIFSNRGKLYEFCSGQSMPKTLERYQKCSYGGPDTAIQNKENELVQSSRNEYLKLKARVENLQRTQRNLLGEDLGSLGIKDLEQLEKQLDSSLRHIRSTRTQHMLDQLTDLQRKEQMLCEANKCLRRKLEESSQQMQGQMWEQHAANLLGYDQLRQSPHQQQAPHHGGNGFFHPLDPTTEPTLQIGYTQEQINNACVAASFMPTWLP

SEQ ID NO: 14051 - protein, 324 aa, Pseudomonas syringae pv. tomato str. DC3000
MQLGIIGLGRMGGNIARRLMLDGHTTVVYDRDEASRGALANEGSTAVADLAELVSALEKPRAVWVMLPAGAPTEDTIQTLSQLLEADDVIIDGGNTFYKDDIRRAQELSEKGLHYVDVGTSGGVWGLERGYCMMIGGDVAAVERLDPLFASLAPGLGSIERTRGRTSTDDRAERGYIHSGPAGSGHFVKMIHNGIEYGMMQAFAEGFDLLKQKNSEHLPAEQRFDLNTADIAEVWRRGSVVSSWLLDLTADALATDPQLDAFSGSVADSGEGRWTIEAAIEQAVPVPVLSSALFARFRSRQTSSYADKMLSAMRFGFGGHKEPK

SEQ ID NO: 14052 - protein, 271 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEREPKATHR

SEQ ID NO: 14053 - protein, 245 aa, Petunia x hybrida
MGRGRVELKRIENKINRQVTFAKRRNGLLKKAYELSVLCDAEVALIIFSNRGKLYEFCSTSSMTKTIEKYQRCSYATLEANQSATDNQNNYHEYLRLKARVELLQRSQRNLLGEDLGTLSTKDLEQLENQLESSLKQIRSRKTQFMLDQLADLQQREQMLAESNKQLRQKLEESVAGIPHRLCWEDGLQAMQHNSRLPQTEGFFQPLGLNSSNSPQFGYNPAGTDVENAAATTHNMNGFIHGWML

SEQ ID NO: 14054 - protein, 465 aa, Arabidopsis thaliana
MEKLSNGVRDHCLISDYVSPSAPAPLKQPFVIGVAGGTASGKTTVCNMIMSQLHDQRVVLVNQDSFYHSLTKEKLNKVHEYNFDHPDAFNTEVLLSCMEKLRSGQPVNIPSYDFKIHQSIESSSPVNPGDVIILEGILVLNDPRVRDLMNMKIFVDTDADVRLSRRIQRDTVERGRNIQNVLEQYTKFVKPSFDEYIQPSMKYADIIIPRGGDNDVAIDLIVQHIRTKLCQHNLCKIYSNIFIISSTFQIKGMHTLIRDINTTKHDFVFYADRLIRLVVEHGLGHLPFTEKQITTPTGSVYTGVDFCKRLCGVSVIRSGESMENALRACCNGIKIGKILIHRENNDGRQLIYEKLPKDISSRHVFLLDPVLASGYSAVKAITLLLSKGVPESHIIFLNLIAAPQGIHALCKKFPMLKIVTSEIDSSLNEDSRVIPGLGEFADRYFGTNNINSKVSSLSTNLKLRS

SEQ ID NO: 14055 - protein, 277 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 14056 - protein, 211 aa, Oryza sativa
RGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAGNGYLLK

SEQ ID NO: 14057 - protein, 698 aa, Solanum demissum
MSLNRTCNSSFWTKEEDKAFENALAVFSGDNDKFLKIAAAVPGKSLQEIIDHYNVLVEDINDIESGKVPLPKYERMQSSSSCRRRSLGAGVERRKGLPWTAEEHRSFLQGLAKHGKGDWRGISRNFVFSRTPTQVASHAQKYYSRLNDNNAKRRKSIHDVTSVGAANITEPSQGQKSDELTGPCGGQSQWPIADYVTEAFDTGMLSLPGSVTNCTTDAIEGPSAVNPEKFPLVAALGSELNSSFPGVDEFLQSVEDLIIVPAEGTSGVCHGVDTRTSPSLSVQPSVTGGTGMYTHPVSFPDVHEFLQEVEDLITVPAEGTSGACHGIDTRTSPSLSLQSSVAGGTRMYTHSVTVPAEGTSGVRCGIDTRTSPSLSLQPSVAGGTRMYPHPVNVLAEGTSGASHGVDTRTSPSLSLQPSVAGGSRIYPHPVNVPAEGISGVSHGVDTRTSPSLSLQPSVGGGTGMYTHPVTVRVEGTSGARRGVDTRTSPSLSLQPSVVGGIGMYTHPIIVPAEGTSGTRRGVDTRTSPSLSFQPSVGGGTGMYTHPVTVLAEGTSGVRCGVGTRTSPSLGLQPSVAGGTRMYTHAVNNVGYDLEELMTKQLVGASQEGPSINTASLPSPIADHIGLHGCTTSSSVAKNGFVSTMEAPGGGFSVDSMQTPSIPGHIGGGTYPCWEPSSKDDSIFDLEYLYTDHMFGFRK

SEQ ID NO: 14058 - protein, 212 aa, Eucalyptus globulus
FVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 14059 - protein, 503 aa, Vibrio cholerae
  unsure (1)..(503): unsure at all Xaa locations
MHMSKSFLIISMGFVAVSVQAQTLTRDNGAPVGDNQNSITAGEHGSVLLQDVHLIQKLQRFARERIPERVVHARGTGAHGEFVASGDFSDLTLSAPFTSKGKITPVFVRFSTVIHSKGSPETLRDPRGFATKFYTEQGNWDLVGNNLPVFFIRDSIKFPDMVHSLKPSPVTNLQDPNRFFDFFSHEPGSTHMLTWVYTNLGTPASYRTMDGFGVHAYKWINQKGDVNYVKFHWKSLQGIESLRPDEVVKVQGQDFNHLTNDLYTQINAGNHPKWDLYVQVLTPEQLSKLDYNGLDATKVWLDVPEKKVGTMTLNKVPDNFFLETEQSAFAPSNLIPGIEPSEDRLLQGRLFAYADTQLYRLGANLFQLPINRPLVEVNSHNQEGASNSAQTASDINYQPSRKLELKEDPQFKAVQTQLVGSVQQKAISNPRNFYQAGVLYRSLNEQDKQDLITNLXGBLNKVTDKEIKATMVSHFYRADKDYGTRLARATNTDLKQVAKLAAM

SEQ ID NO: 14060 - protein, 499 aa, Zea mays
YNLGVQMSADASAAMEKIRAAGLLKTQGLIAGQWVDAYDGKTIEVQNPATGEVLANVSFMGSRETSDAIASAHSTFYSWSKLTASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 14061 - protein, 447 aa, Gymnogongrus chiton
  unsure (1)..(447): unsure at all Xaa locations
ALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGALDFLKDDENINSQPFMRWKERYLYSMEGVNRSIAASGEVKGHYLNVTAATMENMYERAXFAXXXXXXXXMVDLVIGYTAIQSMAIWARKNDMILHLHRAGNSTYSRQKSHGMNFRVICKWMRMAGVDHIHAGTVVGKLEGDPLMIKGFYNTLLLPYLEVNLPQDIFFEQDWASLRKVTPVASGGIHCGQMHQLLDYLGIDVILQFGGGTIGHPDGIQAGAIANRVALETMVIARNEARDYVAEGPQILQDAAKTCGPLQTALDLWKDITFNYTSTDTADFVETPTANV

SEQ ID NO: 14062 - protein, 227 aa, Arabidopsis thaliana
MVGVSPKIAPSMLSSDFANLAAEAKRMIDLGANWLHMDIMDGHFVSNLTIGAPVIESLRKHTNAYLDCHLMVTNPMDYVDQMAKAGASGFTFHVEVAQENWQELVKKIKAAGMRPGVALKPGTPVEQVYPLVEGTNPVEMVLVMTVEPGFGGQKFMPSMMDKVRALRNKYPTLDIEVDGGLGPSTIDAAAAAGANCIVAGSSVFGAPKPGDVISLLRASVEKAQPST

SEQ ID NO: 14063 - protein, 268 aa, Oryza sativa (japonica cultivar-group)
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 14064 - protein, 176 aa, Glycine max
  unsure (1)..(176): unsure at all Xaa locations
MAHSMISFRAVTTVNRARADMVAPFTGLKSMAGFSTRKTNNVITSIASNRGRVQCMHVWPPVGKKKTETLFYLPDLDDAQLAKEVECPVRKGWIPCYELEFEHAFVYREHNKSPXYYNGHYWTMXKLPIFDCTNTAQVWKELQETKTAYPNDFIHIIGFDDVLQMQVINYITYKPA

SEQ ID NO: 14065 - protein, 202 aa, Oligotropha carboxidovorans
MEAIDAAGADWIHCDVMDGHFVPNISFGPDVIKAIRPRTKKVFDVHLMIAPVDPYLEAFAKAGADVITVHAEAGPHLDRSLQAIRNLGKKAGATICPATPENVLANVLDRLDLILVMSVNPGFGGQQFISSQLDKIRRIRAMIGERPIRLEVDGGVNVETAAQVAAAGADTVVAGAAVFKGGTQSAYATNIAAIRAAAGTAR

SEQ ID NO: 14066 - protein, 350 aa, ASPERGILLUS NIDULANS FGSC A4
MSIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPLDAAAPVLCAGITVYKGLKEAGVRPGQTVAIVGAGGGLGSLAQQYAKAMGIRVVAVDGGDEKRAMCESLGTETYVDFTKSKDLVADVKAATPDGLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 14067 - protein, 176 aa, Triticum aestivum
  unsure (1)..(176): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGXCTDATQVINEVEEVKKEYPDAYVRIIGFDNMRQVQCVSFIAFKPPGCEESGKA

SEQ ID NO: 14068 - protein, 94 aa, Oryza sativa
LGEPEAEPRGVAGNVLNTYSIRAFFQKIMLFFVQMTAKFPLGIIFLLIVLYAVPARVAVLVLYVPVTVLFAPPSFLILYFAYPRLDWLVKEIFN

SEQ ID NO: 14069 - protein, 250 aa, Gracilaria gracilis
NWKCNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 14070 - protein, 159 aa, Triticum aestivum
  unsure (1)..(159): unsure at all Xaa locations
MAAAMAAPGAPPAEVPSYFLCPISLQIMRDPVTLPTGISYDRAAISRWLAASAAPAACSASQRTCPVTRQPLEPELQLTPNHTLRRLIGSWVASVSPGSDVEGEVAALRPVRRDELASLLSDAAAAQVGALRKLGELVAECEDTRAMLESQDXVFDALS

SEQ ID NO: 14071 - protein, 245 aa, Zea diploperennis
SIRNNPVPNKLMNGEDPINNNHAQTASGLGVRLATSSSSRDPSPSHEDMDGEVEILGFKMPTHERMRKRKESNRESARRSRYRKAAHLKELEDQVAQLKAENSCLLRRIAALNHKYNDANVDNRVLRADMETLRVKVKMGEDSLKRVIEMSSSSVPSSMPISAPTPSSDVPVPVPPHIRDSIVGYFSAPAADDDASVGNGFLRLQAQEPASMIVGGTTLSATEMNRVAAATHCAGAMELIQTAMG

SEQ ID NO: 14072 - protein, 441 aa, Spyridia hypnoides
  unsure (1)..(441): unsure at all Xaa locations
PQPGVDAXEASAAVAGESSTATWTVVWTDLLTACDLYRAKAYKVDAVPNSSEQYFAYIAYDIDLFEEGSIANLTASIIGNVFGFKAVKALRLEDMRIPYAYLKTFQGPATGLIVERERMDNFGRPFLGATVKPKLGLSGKNYGRVVYEGLKGGLDFLKDDENINSQPFMRWKERFLYSMEAVNRSIAATGEVKGHYMNVTASTMEDMYERAEFAKELGXXXXXXXXXXXXXAIQSMGIWARKNDMILHLHRAGNSTYSRQKNHGMNFRVICKWMRMAGVDHIHAGTVVGKLEGDPKMIQGFYRTLLEPFLEVDLPQGLFFEQDWASLRKVTPVASGGIHCGQMHQLIQYLGIDVVLQFGGGTIGHPDGIQAGATANRVALESMIIARNEGREYISEGPQILRDAAKTCGPLQTALDLWKDITFNYTSTDTADFVETSTANV

SEQ ID NO: 14073 - protein, 568 aa, ASPERGILLUS NIDULANS FGSC A4
MALHKVLTATLSAITSPASDDPILQCFDNDHQALHENLLNNTDETLRLSDAKLRVFPFKDVQPCWRRLYTDASILKASLSICNHLGLIDQDTDNTQTSGQLLVSQLIQLLNSYAGDGLRVDPAAPWLSPVIHLVDKALIMTGAPLREDLIESLLSALQNATRPRTLDKGNVLNSSESGDSPSRASKRRKLSPPLFPPDAVPPPSLKYPVTRVSNPSFDYMEEHIQNVKTPLVITDAVEHWPAMSNRSWASRDYWLERTFGGRRLVPVEIGRSYTDEGWGQRIMEFKEFVDKYIWRNPSTSTARLRSPAAEVGDQVEGQDLDEREDANKTGYLAQHDLLSQIPALRKDISVPDFCYIDPPAPDPGTPVYLKKCQEQEEERKRKATTVGSNTDEAHDNATGDFVTDDILTPPSDPIINTWIGPSWTISPLHHDPYHNILVQVTGAKYIRLYSPHTPASQIHPRGMEAVASDKERRNSHSSPGNGAGRVGSDGDDTSTARMIDMSNTSQVDVAAIELSPAESEQWEAMWPGFQQAEYFETILREGESLYIPVGWWHYVRGLKAGISVSFWW

SEQ ID NO: 14074 - protein, 344 aa, Enterococcus faecalis V583
MKNGGVFVSIALLVTITLVMGVIFVNGWTDAPNAIATAVSTRVLKPNVAIWMAVVMNFLGALVMTFFNAQVAETISNIVSFDANGNASQVALAASLFSIVVWAVAAWYFGIPTSESHALIAGLTGSAMALGGLGAVNGSEWIKVLVGLVVSTVMGFGGGYLIAKLVVKAFSAVPRRKANKFFTVGQAFGAGANAFLHGAQDGQKFMGVFMLVLFYNNLVEKTGGGFVIPLWVMVLCSITMGIGTSVGGMRIIKSVGMDMVKLERYQGFTADLSTAICLFLASAFGIPVSTTHTKTTAIMGVGASKRISSVDWRIVKEMLIAWILTFPGCGLIAYVMSKLFIAIF

SEQ ID NO: 14075 - protein, 459 aa, Staphylococcus aureus subsp. aureus MW2
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVIAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 14076 - protein, 103 aa, Amaranthus retroflexus
VFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRS

SEQ ID NO: 14077 - protein, 216 aa, Brucella melitensis 16M
MPPNSWPGWPGFQCAFTVRLKQTGISPMAQPRLTPLVESLPSTVPFIGPETLELQRGKPFEARIGANESSFGPAPSVIEAMRNEATEVWKYGDPENYALRHAIAAHHGLKAEHIMPGAGVDALLGLIVRQYVQQGDKVINSLGGYPTFNYHVAGYGGQLVTVPYRDDKPDLDALIDAAAREKPALLYIANPDNPMGTWHGGPISSPSLSVFRKQHY

SEQ ID NO: 14078 - protein, 254 aa, Aquifex aeolicus VF5
MPQYALVIDLNTCVGCHACATNCKEWNTQAAFGPLSDYDPYGREASGVWYNRIFTYETGEFPETQVFHLPKSCLHCQDAPCVPVCPTGASYKREQDGIVLVNYDDCIGCKLCSWACPYGCREFDEADKVMKKCTLCIDRIYDETLPPEHRQPACVLTCPARARFFGDIEDPNSEVYKLIKERNGFVLFPDMGTNPANHYLPRQETRINLEEFEKHILKPDNPLFLEVMRRHHTSSKAQAQETPQEEVTHSEELP

SEQ ID NO: 14079 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKHKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNAL

SEQ ID NO: 14080 - protein, 93 aa, Triticum aestivum
  unsure (1)..(93): unsure at all Xaa locations
GEAAAVPKGYFAVYVGAEARRFVVPMSYLHQPAFRALMELAAEEFGFGXAGGLRIPCREEDFVAIVAALEATAERQRRRSAAGRKSRSNATPW

SEQ ID NO: 14081 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 14082 - protein, 472 aa, Thalassionema frauenfeldii
DRYESGVIPYAKMGYWDASYAVKNTDVLALFRITPQPGVDPVEAAAAVAGESSTATWTVVWTDLLTACERYRAKAYRVDPVPNASDQFFAFIAYECDLFEEGSLANLTASIIGNVFGFKAVSALRLEDMRIPHSYLKTFQGPATGIVVERERLNKYGVPLLGATVKPKLGLSGKNYGRVVYEGLKGGLDFLKDDENINSQPFMRWRERFLYCMEGINRASAATGETKGSYLNITAATMEEVYKRGDYAKAVGSVIVMIDLVMGYTAIQSIALWARENDMLLHLHRAGNSTYARQQNHGINFRVICKWMRMSGVDHIHAGTVVGKLEGEPLMIKGFYDVLRETTLDVNLPYGIFFEMDWASLRKCMPVASGGIHCGQMHQLIHYLGDDVVLQFGGGTIGHPDGIQAGATANRVALEAMVLARNEGLDFFNQEIGSGILREAAKTCGPLQTALDLWKDISFNYTSTDTADFAET

SEQ ID NO: 14083 - protein, 335 aa, Synechocystis sp. WH 8501
MSLIRNQSSSLNSWLLLVAPFFLWGTAMVAMKGVLSQTTPFFMAGIRLVPAGFLVLLVAWWLKREQPGGIKAWLWISIFALLDGAMFQGFLAAGLTRTGAGLGSVIIDSQPIAVALLSRWLFGEIIGFWGGIGLGFGVFGIALIGLPQEWFNSLFSAQSFSVTLNSLDLFNSGELLMLLASLSMAAGTVCIRYVSRYADPVVATGWHMVLGGIPLFFLSGIWESNQWNGIDLQGWLSLGYSTIFGSAIAYGIFFYLASKGNLTSLSSLTFLTPVFALSFGNLFFNEILTSWQWLGVSLTLVSIYFINQREMIEKQFNSLRSKFWDFSKRTMSKLS

SEQ ID NO: 14084 - protein, 335 aa, Xylella fastidiosa Ann-1
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSRARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 14085 - protein, 177 aa, Zea mays
  unsure (1)..(177): unsure at all Xaa locations
MVLEATMICIDNSEWMRNGDYAPSRFQAQADAVNLICGAKTQSNPENTVGVMTMAGKGVRVLVTPTSDLGKILACMHGLEXVGAEANLGCGNPGAQLALKHRQNKRQQQRIIAFMGGLGEQQESFETLGKKLKKNXVALEILNFGGTPGEKPEKRKLGFGLLTPGKPPLCLSPPGEK

SEQ ID NO: 14086 - protein, 181 aa, Zea mays
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 14087 - protein, 437 aa, Kluyveromyces lactis
MPISKVYARSVYDSRGNPTVEVELTTEKGTFRSIVPSGASTGVHEALELRDGDKSKWLGKGVLTAVSNVNNIIAPALVKANVDVTNQQQVDDLLLSLDGTANKSKLGANAILGVSLAASKAGAAAKNVPLYQHLADLAGAKTQPFVLPVPFLNVLNGGSHAGGALALQEFMIAPTGAETFAEALRMGSEVYHNLKSLTKKRYGASAGNVGDEGGVAPNIQTAEEALDLIVDAIKAAGYEGKIDIGLDCASSEFYKDGKYDLDFKNPESDPSKWLSGPQLADLYHELVKKYPIVSIEDPFAEDDWEAWSHFYKTAGVQIVADDLTVTNPVRIATAIEKKAADALLLKVNQIGSLSESIKAANDSFAANWGVMVSHRSGETEDTFIADLVVGLRTGQIKTGAPARSERLAKLNQLLRIEEELGSNAIFAGKKFHNGNQL

SEQ ID NO: 14088 - protein, 193 aa, Triticum aestivum
LLPWFDGMIAADEAYFKAHGEPLFSSHMLDLSEEPVEENIETCLKYLQRMAPMGCLLEMEIGITGGEEDGVDNTGVDNSALYTQPEDIWEIYRRFSEITDLFSIAAAFGNVHGVYAPGNVKLHPELLGKHQAYVKEQLKAEDEKPVYFVFHGGSGSTREEIDVALKNGVVKMNIDTDTQWAYWKGLRDFYENK

SEQ ID NO: 14089 - protein, 275 aa, Escherichia coli
GQINVSFEFFPPRTSEMEQTLWNSIDRLSSLKPKFVSVTYGANSGERDRTHSIIKGIKDRTGLEAAPHLTCIDATPDELRTIARDYWNNGIRHIVALRGDLPPGSGKPEMYASDLVTLLKEVADFDISVAAYPEVHPEAKSAQADLLNLKRKVDAGANRAITQFFFDVESYLRFRDRCVSAGIDVEIIPGILPVSNFKQAKKFADMTNVRIPAWMAQMFDGLDDDAETRKLVGANIAMDMVKILSREGVKDFHFYTLNRAEMSYAICHTLGVRPA

SEQ ID NO: 14090 - protein, 370 aa, Bacillus cereus ATCC 14579
MRVKEQLLTLRAYVPGKNIEEVKREYGLSKIVKLASNENPFGCSARVTEALTSLASQYALYPDGYAFELRTKIAEHLGVKAEQLLFGSGLDEVIQMISRALLHEGTNVVMANPTFSQYHHHAVIEGAEVREVSLKDGIHDLDAMLEQVDEKTKIVWICNPNNPTGTYVEKQKLLSFLESVPKSALVIMDEAYYEYAEAEDYPQTLPLLEKYENLMVLRTFSKAYGLAAFRIGYAIGDAKLIGQLEVARLPFNTSTVAQSVALAALEDQAFLQDCVQKNAEGLNQYYAFCKEYNVFYYPSQTNFIFLKLGIPGNEAFERLMKKGYIVRSGAAFGIDDGIRITVGLKEENDEIIELLKELVNEQVQKEETYS

SEQ ID NO: 14091 - protein, 179 aa, Streptomyces coelicolor
MSVPLDKQTAAPSLAHKAVGYGMPGRLVDGNDAAAVHEVLSDAVRHARAGGGPTLVEAVTYRVDAHTNADDATRYRGDAEVETWRRHDPVELLERELTERGLLDEDGIRAAREDAETMAADLRARMNQDPELDPLELFAHVYAEPTPQLREQRDQLRAELAAEAETAARQAGALEGGRR

SEQ ID NO: 14092 - protein, 539 aa, Zea mays
  unsure (1)..(539): unsure at all Xaa locations
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPXPAYRDDHFTSTVPQADFVWRVILMLGAAPALLTYYWRMKMPETARYTALVAKNAKQAAADMSKVLQTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 14093 - protein, 492 aa, Cicer arietinum
LHQVIKANDDLSREHHQFFLYQMLRALKYMHSANVYHRDLKPKNILANSNCKLKVCDFGLARVAFNDAPTSIFWTDYVATRWYRAPELCGSFSSKYTPAIDIWSIGCIFAEVLLGKPLFPGKSVVHQLDLITDLLGTPLPETITGVRNDNARKYLAGMRKKLPVPFEQKFPNADPLALRLLQRLLAFDSKNRPTAEEALADPYFKGLAKVEREPSCKPISKLEFEFERRRITKDDVRELIYREILEYHPQLFKDYMNGTEGANFLYPSAIDQLRKQFAYLEENDGKSGSVLPPERKHVSLPRSTVYSGSILPSNQRTPALYEKKKMVEETSKSWGAAGENSRNQLRGVQPPPRVPAKPGRVVGPVLHYEDERITKSSNDPRIVIQNTTQAVSSRDAFQTHPPNTKTTSGIHKEQGKNEFPSLQSNLHATATTDLNNNPYRRRVINNNLNDPVTTIDAKMLQAQSHLGVVGAAAVAVATHSHRYSRGIQYGLF

SEQ ID NO: 14094 - protein, 624 aa, Schizosaccharomyces pombe
MDLLGLKELDNNKLVSKAKENGVEFSDLFLLSSGYLRDRENASASVSSKNERMVLNEERQNCWTKRNDPKGLTYYQLLKPSEVEILSRPETRRKRMACQVFFLNYYISTIEYHKLRKERLEEFTACTSSLKQSKQKRLWKEHCGRERAFLRKKRTKIQCSHFDLLVKLGQGGYGSVWLAKKRNTHELLAMKMMKKSTLQQLNEVKHILNERDILTNTNSEWLVKLYYAFQDKEKVYLAMEYVPGGDFRTFLTTKGLLHENQTRFYLAEMVAAISAVHKLGYMHRDLKPENFLIDQKGHIKLSDFGLSTAIVTSNQVNRLQHALVSAVNPQRPYLTQKQRRNIYKALLEKNENKVNSVVGSPEYMAPEVVYGKKYDRTVDYWSLGCICYECLVGYPPFSGSTLQETWTNLYYWREMLQRPSKNENGIYDKKARSVSDEAWSFITKCLTEPTSRFQSTIEIQKHPFFKRLHWNGLRKRAVPPFVPRLENQLDTSYFDDFNDEQVLDAYKDVYEKQRKAEQKAKSNGVMNGNQRQFLGFTFKYRPNARKPLVGRHREKRQLRKEKPEKKNNSTKQKDLITVSHNKGTTAIEDLDEDKRSKTKGHKTKSSRVHRLLERKGKDLYEFLL

SEQ ID NO: 14095 - protein, 387 aa, Petroselinum crispum
MDGSTQPSDTVMSDAAPASQTAGIENIPASLSHGGRFIQYNIFGNIFEVTAKYKPPILPIGKGAYGIVCSALNLETNEHVAIKKIANAFDNKVDAKRTLREIKLLRHMDHENVVAIRDIIPPPQRGSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAELEFLNENAKRYIRQLPLYRRQSLTEKFPNVHPSAIDLVEKMLTFDPRRRLTVEDALAHPYLTSLHDISDEPVCAAPFSFDFEQHALTEEQMRELIYREALAFNPEHQQM

SEQ ID NO: 14096 - protein, 392 aa, Triticum aestivum
  unsure (1)..(392): unsure at all Xaa locations
ASDYDRLRAVKAFDDTKAGVKGLVDAGVTTIPSIFHHSLPIEHTDHDHHFTIPVIDLAAATGGTTTTPSMRAELVAAVKAAAETVGFFQVVNHGVPKAVMSEMLAAVRGFHEEPVGAKAPYYGRDYGRPVRYWSIFDLFQSQAANWRDTLIIDTAPELPPPEEIPPTCRSIAPKYAKMMEQLGRTLLELLSEALGLRSGHLEEDASCLERLAGHYYPPCPEPHLTLGTTRHSDPCFLAGLLQDAVGGLQVLLKEDYDGGGGSNNNNNNKSSAVWVDVPAVEGALVVNVGDFLQIVSNDRFKSVEHRVVAQSAGPRVSVXCFFRRQDAPTSTKVLGPIVADGEARFRTPTVAGLLPRHGPKGLARTSALRPSGLCFSLRKSSFRLRSPRYLRG

SEQ ID NO: 14097 - protein, 560 aa, Coxiella burnetii RSA 493
MNNVHAYKRRIGPIGLMMSAVSAMIGSGWLFSSLYVGRLAGPASILAWIFGGILVMIVALTYAEIVTMLPITGGSTRFPQLTHGTFVSLFFGWITWFTLMTAPAIEVQAMIQYAANYWPTLIRHHGAGMHGLSPLGYLIATLMMIGFSLINIYSIRLITRLNNIFSFWKLIIPVLTAIVLMVVAFHPNNFNNPHYGGFMPNGWKGVFAALATGGILFAFNGFKQAVELAGEAENPNRTVIIGILGSLIIVLIIYLLLEIGFIGALSPESLSKGWFFVHFIGDAGPLAGLLMTFGVTWMAILLYIDAMIATSAAGLVYSTSSSRTLYGLSANRQLPKFLQEVNERGIPAKAVFVNFIVGMTFFLPFHGWYAMAEFMSSIIALSYITGPICCLSLRYQLPEHKRVFRLPLITVWSFFGFYICTLIVYWAGWSVVSKLGLSLFISFMLFVVYRLFSKRPRGIHMNWRAATWMWPYLVGLNVISYLGSYGGGINKIHFGWDFLYLAILCFCCLYLAVTFRASDKHVAETLVRFEEEVKTGIPSTVPDEEFENPSLVRKEVSYID

SEQ ID NO: 14098 - protein, 487 aa, Gibberella fujikuroi
IVYYPGKGKLATSSDNAIKLSTSAGTVIGQLGFGMLADIVGRKRMYGLELIVIIFATLAQALTAGSPSTSLVGLIIFWRVVMGVGIGGDYPLSSIITSEFATTKWRGAMMAAVFAMQGIGQLVAALVMMFLTLGFKSSLEGAPDTKHCTGDCQVAVDKMWRTLVGFGAVPACIALYYRLTIPETPRYTFDVARDVEQADEDVKAYINGKREGDTDEVARAQVHASAKSNLQVPKASWSDFCQHYSKWKNLSILIGTAGSWFCLDVAFYGLSLNNGTILKVIGYSTKDANNMYEYLHNTAVGNIIIVLAGAVPGYWVSVATIDTLGRKTIQLGGFIILTILFIVMGFAYNHISSNGLLAIYVLAQFFFNFGPNTTTFIVPGEVFPTRYRSTSHGISAASGKIGSIIGQGAISILRTHGATDKNEAPWMDHVLEIYALFMLLGIFTTLLIPETARKTLEELSGEDDYANNPETTIDTEAHAGKNERTSG

SEQ ID NO: 14099 - protein, 287 aa, Agrobacterium tumefaciens str. C58 (Cereon)
MKKNMTYAADVLVTALAPAIWGTTYFVTTEFLPQGYPLHVAMLRALPAGILLLLLVRKLPQGIWWPRSFILGALNFSFFWAMLFVSAYRLPGGVAATVGAVQPLIVIGLSRLFLSTPVRPLAIGAGFLGIAGVALLVLTPGAALDGIGVAAGLAGAVSMAFGTVLTRKWRPPVSNLTFTAWQLTAGGILLLPVAYALEPALPAPTAVNVMGMAYLGLIGAALTYLLWFRGLARIEPSAAASLGFLSPVVATLLGWLALGQSLAPAQIAGFIAVLFSIWLSQRSQLPR

SEQ ID NO: 14100 - protein, 507 aa, Brucella melitensis 16M
MKLQEDYSMTDRPIMTTSAGAPIPDNQNSLTAGERGPILMQDYQLIEKLSHQNRERIPERAVHAKGWGAYGTLTITGDISRYTKAKVLQPGAQTPMLARFSTVAGELGAADAERDVRGFALKFYTQEGNWDLVGNNTPVFFVRDPLKFPDFIHTQKRHPRTHLRSATAMWDFWSLSPESLHQVTILMSDRGLPTDVRHINGYGSHTYSFWNDAGERYWVKFHFKTMQGHKHWTNAEAEQVIGRTRESTQEDLFSAIENGEFPKWKVQVQIMPELDADKTPYNPFDLTKVWPHADYPPIDIGVMELNRNPENYFTEVENAAFSPSNIVPGIGFSPDKMLQARIFSYADAHRHRLGTHYESIPVNQPKCPVHHYHRDGQMNVYGGIKTGNPDAYYEPNSFNGPVEQPSAKEPPLCISGNADRYNHRIGNDDYSQPRALFNLFDAAQKQRLFSNIAAAMKGVPGFIVERQLGHFKLIHPEYEAGVRKALKDAHGYDANTIALNEKITAAE

SEQ ID NO: 14101 - protein, 415 aa, Osmundea ramosissima
  unsure (1)..(415): unsure at all Xaa locations
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLVVERERMDKFGRPFLGATVKPKLGLSGKNYGRVVYEGLKGGLDFLKDDENINSQPFMRWKERFLYSMEAVNRSIAGTGEVKGHYMNITAATMEDMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLKQNLPQGIFFEQDWASLRKVTPVASGGIHCGQMHQLLDYLGNDVVLQFGGGTIGHPDGIQAGATANRVALEAMVIARNXGIDYVAEGPQILRDAAKTCGPLQTALDLWKDITF

SEQ ID NO: 14102 - protein, 430 aa, Halymenia floresia
ETDVLALFRVTPQPGVDPIEASAAVAGESSTATWTVVWTDLLTACDLYRAKAYKVDAVPNSSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRAIAASGEVKGHYMNVTAATIENMYERAEFAKQLGTVIIMIDLVVGYTAIQTMGIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGEDVVLQFGGGTIGHPDGIQAGATANRVALEAMVIARNEGRDYVAEGPQILQDAAKTWGPLQTALDLWK

SEQ ID NO: 14103 - protein, 459 aa, Chrysochromulina parva
DPDYVIKETDILALFRCTPQPGVDPVEAAAALAGESSTATWTVVWTDLLTACDLYRAKAYRVDPVPGAADTYFCYVAYDIDLFEEGSLANLTASIIGNIFGFKAVKALRLEDMRFPYALLKTYQGPATGLVVERERMDKFGRPLLGATVKPKLGLSGKNYGRVVFEGLKGGLDFLKDDENINSQPFMRYRERFLYSMEGVNHAAAMTGEVKGHYLNATAATMEDMYERADFCNQLGSIIVMIDLVIGYTAIQSMAKWCRKTDTILHLHRAGNSTYSRQKNHGMNFRVICKWMRMSGVDHIHAGTVVGKLEGDPLMIKGFYNTLLDCKSEVNLPEGLFFAQDWASLRKCVPVASGGIHCGQMHQLINYLGDDVVYQFGGGTIGHPDGIQAGATANRVALECMVLARNEGRDYVSEGPQILRDAAKTCGPLQTALDLWKDITFNYASTDTADFATTKTANR

SEQ ID NO: 14104 - protein, 328 aa, Pseudomonas sp. Ki-1z
CIGCHTCSITCKNVWTSREGMEYAWFNNVETKPGIGYPKEWENQDKWKGGWIRNANGSINPRIGGKFRVLANIFANPDLPSLDDYYEPFDFDYQHLHTAPLGEHQPIARPRSLVSGKRMEKIEWGPNWEEILGTEFAKRRKDKNFDKIQADIYGEYENTFMMYLPRLCEHCLNPACAASCPSGAIYKREEDGIVLIDQEKCRGWRMCISGCPYKKIYFNWKSGKSEKCIFCYPRIEAGMPTVCSESCVGRIRYLGVLLYDADRISEVASTANEQELYEKQLEIFLDPNDPAVIRQALAERVPKSVIDSAQRSPVYKMAVDWKLASCRS

SEQ ID NO: 14105 - protein, 108 aa, Oryza sativa
ENEKSGFISLVSRYLSGEAEQIEWSKIQTPTDEVVVPYDTLSAAPEDLNETKKLLDKLVVLKLNGGLGTTMGCTGPKFYMLLYYMYALLSMSLSGVLNVNDMEGLNIV

SEQ ID NO: 14106 - protein, 352 aa, Pseudomonas putida KT2440
MPHRPYKVALNGYGRIGRCVLRALFERGAKAGFEIVALNDLADQASLEYLTRFDSTHGRFPGEVKVDGDCLHINGDCVKVMRSATPEGIDWAALGIDLVLECSGAYNTRADGQRFLEAGAPRVLFSQPMASEADVDATVVYGINQACLTGSERLVSNASCTTNCGVPLLRVLDQAFGIEYVQITTIHSAMNDQPVIDAYHHEDLRRTRSAFQSVIPVSTGLARGIERLLPELAGRIQAKAVRVPTVNVSCLDITLQTARDTSAAEVNRVLREAALEGPLKGLLAYTELPHASCDFNHDPHSAIVDASQTRVSGPRLVNLLAWFDNEWGFANRMLDVAEHFLHVVHPTRTKQP

SEQ ID NO: 14107 - protein, 348 aa, Oryza sativa
MHGRPRRPDKPEDAAAAEAKAAKLRVLQAQVLHNHHSRTYTKEALGLSFKLLEINPEAYTAWNYRKLAFQHNIGELSEPEAIKSAIDDELRVVEVALRQNPKSYGAWYHRKWLLNQKLAPVDFKREFGLLDKLLKVDARNFHGWNYRRFLARFMGVPEEEELKYTIDKISDNFSNYSAWHNRSILLSNLLIKQSKGFESKQKIFSEEFELVTQALFTDPSDQSGWFYHLWLLAQTSSPENPQLIASWPSNGSNLSLSSLSSICCYSLKEGILPIVLYFNEPVKGLSSSSVSLNSDLVVSKNIQWRPLSVTDSGHSNCWVTYLEVSNLECNSLQQFSVEVSITNSDEIV

SEQ ID NO: 14108 - protein, 97 aa, Glycine max
PGSMHMFSKEHNLLGGFAFIGEGIPVATGAAFSSKYRREVLKQADCDHVTLAFFGDGTCNNGQFYELLMGKLLCGKCQICGFCWVGKLNFLWGPNLG

SEQ ID NO: 14109 - protein, 393 aa, Zea mays
  unsure (1)..(393): unsure at all Xaa locations
MATHAALAASRIPAGARLHSRAAASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGXPKKVIITAPAKGADIPTYVVGVNEGDYDHSVADIISNASCTTNCLAPFVKILDEXEFGIVKGTMTTTHSYTGDQRLLDASHRDLRRARAAALNIVPTSTGAAKAVALVLPQLKGKLNGIALRVPTPNVSVVDLVINTVKTGGQVARRRGGRQRRPSGGLLQGQPRDRRVQGVRSMRPGFFPRRNVQHGREGSFHRE

SEQ ID NO: 14110 - protein, 294 aa, Oceanobacillus iheyensis HTE831
MSVKKAIIPAAGLGTRFLPATKAQPKEMLPIVDKPTIQYIVEEAVHSGIEDIIIISGRGKRAIEDHFDKSYELEEKLTEKEDYDMLQEIQQISGLANIHYIRQKEPKGLGHAIHCAHTFIGNEPFAVLLGDDIVVSDEPCLKQLINVFEENHQKSVIGVHDVPWEDVSKYGIVKPSKGLDDSSSIHFIEDLIEKPDRDKAPSNLAIMGRYVLTPEVFPILEKLPPGKDNEIQLTDALIELKKVEEMIAYNFQGKRYDVGNKLGFIEATIDFALNRNDLHNDVKHLLKKKLDSME

SEQ ID NO: 14111 - protein, 183 aa, Eucalyptus grandis
MGRGRVELKRIENKINRQVTFAKRRNGLLKKAYELSVLCDAEVGLIIFSNRGKLYEFCSSSSMLKTLERYQKCNYGALEPNVSARESLELSCQQEYLRLKARYEGLQRTQRNLLGEELGQLCSKELESLERQLDGSLKQIRSRRTQYMLDQVTDLQHREQVVHEANRTLNQRLMEGYQVMRSS

SEQ ID NO: 14112 - protein, 262 aa, Zea mays
MPRGGKPAASSKPNPFDSDSDSESSNKPANKSGASSYQAPADAKKRYKDGFRDSGGLENQSVQELEHYAAYKAEETTDALAGCLRIAEDIRQDASDTLITLHKQGEQISRTHEKAVEIDQDLAKSETLLGSLGGFFSKTWKPKKTRQIKGPAQVSRDDSFKKKASRMEQRDKLGLSPRGKRDPRHYAEATDAMDKVQIEKKKQDDALDDLSGVLGQLKGMAVDMGSELDRQNEALDHLQGDVEELNSRVKGANQRARKLVAK

SEQ ID NO: 14113 - protein, 198 aa, Zea mays
QSFPGLVVLYGGVVKKKWAVNSAFMALYAFAAVWICWVTWAYNMSFGDRLLPLWGKARPALSQGGLVGQAGLPATPAAEPLYPMATVVYFQCVFAAITLVLVAGSLLGRMSFAAWMLFVPLWLTFSYTVGAFSVWGGGFLFQWGVIDYCGGYVIHLSAGFAGFTAAYWVSRSIDRSSANNACVQRAVFISELNSYMPA

SEQ ID NO: 14114 - protein, 169 aa, Bacillus cereus ATCC 14579
MSVTEHKKQAPKEVRCKIVTISDTRTEETDKSGQLLHELLKEAGHKVTSYEIVKDDKESIQQAVLAGYHKEDVDVVLTNGGTGITKRDVTIEAVSALLDKEIVGFGELFRMISYLEDIGSSAMLSRAIGGTIGRKVVFSMPGSSGAVRLAMNKLILPELGHITFELHRQ

SEQ ID NO: 14115 - protein, 490 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQVQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRAEEFCFITDDTYTKAEVLKMEGLVLNDLGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 14116 - protein, 513 aa, Zea mays
  unsure (1)..(513): unsure at all Xaa locations
MFIESFRVESPHVRYGPTEIESEYRYDTTELVHEAKDGASRWVVRPKSVKYNFRTSTAVPKLGVMLVGWGGNNGSTLTAGVIANRXEGISWATKDKVQQANYYGSLTQASTIRVGSYNGEEIYAPFKSLLPMVNPDDLVFGGWDISSMNLADAMTRAKVLDIDLQKQLRPYMESMVPLPGVYDPDFIAANQGXSRANNVIKGTXKKEQVEQIIKDIREFKEKNKVDKVVVLWTANTERYSNVCAGLNDTMENLLASVDKNEAEISPSTLYAIACVTEGVPFINGSPQNTFVPGLIDLAIKNNCLIGGDDFKSGQTKMKSVLVDFLIGAGIKPTSIVSYNHLGNNDGMNLSAPQTFRSKEISKSNVVDDMVSSNAILYGPGEHPDHVVVIKYVPYVGDSKRAMDEYTSEIFMGGKSTIVLHNTCEDSLLAAPIILDLVLLAELSTRIQLKPEGTDKFHSFHPVATILSYLTKAPLVPPGTPVVNALAKQRAMLENIMRACVGLAPENNMILEYK

SEQ ID NO: 14117 - protein, 244 aa, Liquidambar styraciflua
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 14118 - protein, 762 aa, Zea mays
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNEDGGCGTLILGSSTMFGTCSNYITLRLLGEEPYANNSVLAKGRAWILSHGGATLIPQWGKIWLSVLGLFDWSGNNPIFPELWSIPQFLPFHPGKFWCFARMVYLPMAYLYGKKFVGPITPTILALREEIYDTPYGKIDWSDARSKCAKEDLICPRTLLQNVIWTSLYRCVEPVLSSWPINKLRERALGNIMEHIHYEDENTQYLCICPVNKALNMVCCWVEDPNSDAFKRHLARIPDFLWISEDGMKAQVYDGCQSWETSFIIQAFCATDLVNDYGSTLQRAYEFMKNSQVMRNHPGDQRYWHRHRSKGSWTLSSADNGWAVSDTTGEALKAVLLLSKISNKNNLVGDPIERERLHDAIDCLLSFANKDGTFSTYECKRTYSWLEILSPCETFPNIVVDYPYPECTSSVLQALILFKDLYPGYRTEEIEALVRSAATFIETKQQEDGSWLGNWGICFTYGAFFSIKGLVASGRTYKNSPCIRKACHFILSKQLSTGGWGESHIAIETQVYVNLKGDRAHAVNTAWAMLALIYAGQFERDPTPLHRAAKELINMQLETGEFPQQEHVGCFNCSLYFNYPSYRNLFPIWALGEYHRGLRAKKDN

SEQ ID NO: 14119 - protein, 474 aa, Neurospora crassa
MRGDTPRDLVDSLTDGIKGLDVRVVENPDSTIAKRAHYAPPWADVSIIGIAGSSGSGKSTLSQAIVKKLNLPWVVILSIDSFYKSLDAESSRKAFMNEYDFDSPEALDFDVLVDRLQDLKAGKRAEIPVYSFEKHARLDRTTAIYSPHVLILEGIFALYDPRVLELLDMKIFCEADADTCLSRRILRDVKDRGRDVDGIIKQWFNYVKPNFEKFVDPQRKVADIIVPRGVENHVAMTMVTQFIQQKLLEKSKRHRAALTRLESQARHQPLSNKVVQLDQTPQLRGMNTLIHDIDTSKEDFIFYFNRFTTLLIEKAMDNIPFASTTITTPLNREYAGLRPRGQVSAVVVLRGGAALEAGLKRVLPDCKTGRVLIQSNMRTGEPELHYLALPKDIDQHEAVLLLDAQMSSGGSALMAVQVLVDHGVKMDRIVLATYSAGRLGLHRLTTVFPEVTVVVGNVIQDVEERWVEKRYFRC

SEQ ID NO: 14120 - protein, 178 aa, Zea mays
  unsure (1)..(178): unsure at all Xaa locations
CGFWTIKSSAAVWKNYYGVYVLKGGLIMLEDYHLVLDLAEIHIQWMPXSVEYECRNCAYAFFYVAHDVYHIKCADSLRARGRKTSGIGRFSTAEHDRGGAETFGDPRAFAVKFYTREGXFDIACNNMPVFFIRDVMKFPDMLHAFKPNPKTNLXENWRIVDFFSSHPESLHMFTFLFD

SEQ ID NO: 14121 - protein, 280 aa, Saccharomyces cerevisiae
MSVHAATNPINKHVVLIDNYDSFTWNVYEYLSQEGAKVSVYRNDAITVPEIAALNPDTLLISLGLGHPKTDSGISRDCIRYFTGKIPVFGICMGQQCMFDVFGGEVAYAGEIVHGKTSPISHDNCGIFKNVPQGIAVTRYHSLAGTESSLPSCLKVTASTENGIIMGVRYKKYTVEGVQFHPESILTEEGHLMIRNILNVSGGTWEENKSSPSNSILDRIYARRKIDVNEQSKIPSFTFQDLQSNYDLGLAPPLQDFYTVLSSSHKRAVVLAEVKRASPS

SEQ ID NO: 14122 - protein, 538 aa, Zea mays subsp. mays
MGYQVVAAQLKLASSADHASVVIITLFVALLCACIVLGHLLEENRWLNESITALIIGLGTGVVILLISRGKNSRLLVFSEDLFFIYLLPPIIFNAGFQVKKKQFFRNFMTITLFGAVGTMISFFTISLGAIATFSRMSIGTLDVGDFLAIGAIFSATDSVCTLQVLHQDETPFLYSLVFGEGVVNDATSVVLFNAVQKIQFTHINAWTALQLIGNFLYLFSTSTLLGIGTGLITAFVLKKLYFGRHSTTRELAIMILMAYLSYMLAELFSLSGLLTVFFCGVLMSHVTWHNVTESSRTTSRHVFATLSFISETFIFLYVGMDALDFEKWKTSSLSFGGTLGVSGVLMGLVMLGRAAFVFPLSFLSNLAKKHQSEKISFRMQVVIWWAGLMRGAVSMALALNKFTRSGHTQLHGNAIMITSTITVVLFSTMVFGMITKPLIRLLLPASGHPRELSEPSSPKSFHSPLLTSQQGSDLESTTNIVRPSSLRGLLTKPTHTVHYYWRKFDDALMRPVFGGRGFVPFVPGSPTERNPPDLSKA

SEQ ID NO: 14123 - protein, 593 aa, Zea mays; identical to SEQ ID NO: 11982

SEQ ID NO: 14124 - protein, 163 aa, Triticum aestivum; identical to SEQ ID NO: 13597
  unsure (1)..(163): unsure at all Xaa locations

SEQ ID NO: 14125 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 14126 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPPVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 14127 - protein, 432 aa, Novosphingobium aromaticivorans
MSSEGMSGMARGNLPSLSLHVPEPKFRPGDKVDYSDLAISRAGEQPRPDEQCEASETHPLCLDLVRVLGDDDRAIGPWDPRLDADTLRRMLRTMALTRAFDDRMYRGQRQGKTSFYMKCTGEEATSVAPAMALADDDMVFPSYRQQGILIARGYPLVEMINQIYSNRADKLKGRQLPIMYSAREQSFFTISGNLATQYPQAVGWAMASAIKGDSRIAATWIGEGSTAEGDFHSAMTFAAVYNAPVIFNVVNNQWAISSFSGFAGAERTTFAARAIGYGIAGLRVDGNDPLAVFAATQWAANRARANAGPTLIEHFTYRAEGHSTSDDPTQYRSAQEREEWPLGDPVNRLKKHLVALGEWSDEQHEAMDRELVDLVKAATKEAEKNGILGHGLHHPFHTMFEDVFEELPWHLREQSEQAIRERRIKWPEWKES

SEQ ID NO: 14128 - protein, 392 aa, Nicotiana tabacum
NSSLQVSNKGFSEFSGLRTSSAIPFGRKTNDDLLSVVAFQTSVIGGGNSKRGVVEAKLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 14129 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAEATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 14130 - protein, 474 aa, Triticum aestivum
  unsure (1)..(474): unsure at all Xaa locations
MAAAAVAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPXKGQTGKDGWXYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 14131 - protein, 430 aa, Acrosorium sp. 1
AAVAGESCTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEVKGHYMNVTAATMEEMYERAEFAKQLGTVIIMIDLVIGYTAIQTMAIWARRNDMILHLHRAGNSTYSRQKIHGMNFRVICKWMRMAGVDHIHAGTVVGKLEGDPLMIKGFYDTLLLPYLDINLPLGIFFTQDWASLRKVTPVASGGIHCGQMHQLLDYLGDDVVLQFGGGTIGHPDGIQAGATANRVALESMVIARNEGVDYVTEGPQILRDAAKTCGPLQTALDLWKDITFNYTSTDTADFVETPTPNV

SEQ ID NO: 14132 - protein, 183 aa, Methanosarcina mazei Goe1
MSESSIKIENVVASTKLAEEFDLTVIESEFEGAEYNKQKFPGLVYRVSDPKAAFLVFTSGKVVCTGTKNVADVHTVVGNLAKKLNSIGIKTIENPQITVQNIVASADLHTILNLNAIAIGLGLENIEYEPEQFPGLVYRIDEPKVVVLIFSSGKLVVAGGKSPEDCERSVEVVRQQLDSMGLL

SEQ ID NO: 14133 - protein, 580 aa, Glycine max
  unsure (1)..(580): unsure at all Xaa locations
MEAERKRLKPRLERRNAMKNIDYQLKDEDADADADAAYLNQRSFRVKGIDGEFDRILRSLGLSGPEDFAIPAAAWEEARAHKARSSVQPREGGIKGVRPPVLEPPLVTSAWTSQQQTERVPPSDSVSRDDDVAVEAQTEEVSGFADDHGSFDIHNLSPMEVGISGSWQKGDILXNESSTGIKGTRPPMLKPPPGARVQVVDDSTCSTWDLLRDLAPQGEEGLPLNRSENESEVAREVERGAVEKEEGEVGTRESPKREEEENVAGLSESCSFSTSNEDDSSSSTTDPTSNNISPQGRIKRIITAESWQKGEFLGGGSFGSVYEGISDDGFFFAVKEVSLLDQGTQGKQSVYQLEQEIALLSQFEHENIVQYYGTEMDQSKLYIFLELVTKGSLRSLYQKYTLRDSQVSSYTRQILHGLKYLHDRNVVHRDIKCANILVDASGSVKLADFGLAKATKLNDVKSMKGTAFWMAPEVVKGKNKGYGLPADIWSLGCTVLEMLTGQLPYCDLESMQALYRIGKGERPRIPDSLSRDAQDFILQCLQVSPNDRATAAQLLNHSFVQRPLSQSSGSSFPHIHGRKG

SEQ ID NO: 14134 - protein, 318 aa, Betula pendula
MATFPVIDMEKLNGEERGATMELIEDACENWGFFELVNHGISHDLLDTVEKLNKEHYRKCMEERFKDMVASKGLEAAQSEVRDMDWESTFFLRHLPASNMSEIPDLDEDYRKAMKEFAGNLEKLAEQLLDLLCENLGLEKGYLKKSFYGSKGPNFGTKVSNYPPCPKPELIQGLRAHTDAGGLILLFQDDKVSGLQLLKDGKWVDVPPMRHSIVINLGDQLEVITNGKYKSVLHRVLAQPDGNRMSLASFYNPGSDALIYPAPVLVEKEAEKGQVYPKFVFEDYMKLYAGLKFQAKEPRFEAMKAMESTVKLGPIATA

SEQ ID NO: 14135 - protein, 364 aa, Malus x domestica
QMGLAENQPCFDLIQEWMVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVEITTLKSNAGLFIWMDLRRFLENSTFDDELKLWHIIINKVKLNVSPGCSFHCSEPGWFRVC

SEQ ID NO: 14136 - protein, 701 aa, Neurospora crassa
MSSYLTNFFPSGGKQDGTRPQTPMRPGTSSFVNPVSTPQGSPSKRTLPPGANELPAAFESMKLSTPTKLATSSRPGTSSKLGTPSALDSPIKLGRPQSVVTPLSPGKSNLKDVGDDTFEDLTGNGSAVSVVHKQVDKNLPKPYPVPTSRRKERDQNQENTPPVVTRDPRDPRDPATEPTYQRSHAALSRQELYQARERASPTVKRFNTSRGLTPEERELLNKPNVKRLVNVTQLYFLDYYFDLLTYVGQRQNRLNAFKAEFPPPPETDEETYKQMWHKYAGRERANLRKRRVRLRQGDFQILTQVGQGGYGQVFLAQKKDTKEVCALKVMSKKLLFKLDEVRHVLTERDILTTAKSDWLVRLLYSFQDDKNIYLAMEYVPGGDFRTLLNNTGVLSNRHARFYIAEMFCAVDALHQLGYIHRDLKPENFLVDSTGHVKLTDFGLAAGFLAPAKIESMRIRLEKASETSVPFGKPMDQRTVAERREGYRTMRDRDTNYAKSIVGSPDYMAPEVLRGEEYDYTVDYWSLGCMLFEALTGFPPFAGSTADETWRNLKHWKEVLKRPVWEDPNYFLSNRTWSFITTCINSRSRRFNNIKDIYAHHYFAEVDWAILRETKAPFVPELDSETDAGYFDDFSNEADMAKYKEVHEKQQALEGLAERGEEMNKSLFVGFTFRHRKPATDDGASPRKPIPFEESNNFGTML

SEQ ID NO: 14137 - protein, 303 aa, Streptomyces coelicolor A3(2)
MSSTLSENQAPETGTARVKRGMAEQLKGGVIMDVVTPEQAKIAEDAGAVAVMALERVPADIRKDGGVARMSDPDMIEGIIGAVSIPVMAKSRIGHFVEAQVLQSLGVDYIDESEVLTPADEVNHSDKFAFTTPFVCGATNLGEALRRIAEGAAMIRSKGEAGTGNVVEAVRHLRQIKNEIARLRGYDNNELYAAAKELRAPYELVKEVSELGRLPVVLFSAGGVATPADAALMRQLGAEGVFVGSGIFKSGDPAKRAAAIVKATTFYDDPKIIADASRNLGEAMVGINCDTLPETERYANRGW

SEQ ID NO: 14138 - protein, 518 aa, Lycopersicon esculentum
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 14139 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 14140 - protein, 139 aa, Triticum aestivum
MTMIHPKRLAQLVRKWQRVKSVARDDEACCTTSPVADKGHCAMYTVDGRRFEVPLAYLGTTVFGELLRMSQEEFGFTCDSRITLPFDAVVMEYVMCLLRRNASEEVERAFLSSVVMPCQYPSCTVPHVVLHQQLAVCSS

SEQ ID NO: 14141 - protein, 193 aa, Zea mays
LLRDERPDIVVVVGADHVYRMDFHQMVVAHIASGRSATVAAIRQPIGLADQFGVIQVAEDDPTRIDAFLEKPKDAVGLADSPGEILASMGNYVFNADALVDAVLRDGQVETSNHDMGGDIVPDFVNRGDAGVYDLQRNDVPGSNERDRYYWRDVGTIDSFYDAHMDLIGPVPVFNLYNQDWPIFNQQTNLPPA

SEQ ID NO: 14142 - protein, 144 aa, Triticum aestivum
  unsure (1)..(144): unsure at all Xaa locations
MDGGGGVRPSLPSAAAGGASGADEPRDARVVRELLRSMGLGEGEYEPRVVHQFLDLAYRYVGDVLGDAQVYADHAAKPQMDADDVRLAIQAKVNFSFSQPPPREVLLELARSRNKIPLPKSIAPXGSIPLPPEQDTLLSENYQL

SEQ ID NO: 14143 - protein, 55 aa, Glycine max
RGVEDFILRASARGQITEKVSEERLISLLEQINNQTTRQTKVTIQRRRSVLEDDD

SEQ ID NO: 14144 - protein, 718 aa, Filobasidiella neoformans
MLTRQARLLRRIPPPNAVLQSGLQRRHRSTDRYSNNIHTSSTQNAPAPVYDTPIREKGMTLEAKERVRAHVRKIQSSASTAAASPAVRPQPAQHFQAAPQPMPTNMPRFESDSQVKNGLDYSFIGLSGGQIFQEMMLRHDVKQVFGYPGGAILPVFDAIYNSPHFEFVLPRHEQGAGHMAEGYARVSGKPGVVLVTSGPGATNVITPMQDALSDGVPMVVFCGQVATNLIGSDAFQEADVVGISRSCTKWNVMVKDIAELPRRINEAFKIATTGRPGPVLVDLPKDVTAAILRTPIPAKSVQPGHSPYLPSNPLNPSSQPSDPLPGDADLITEAAQMINKAKRPIIFAGNGVLSSPEGPKLLKELSDKGRIPVTTTLQGLGAFDERDEKSLHMIGMHGSAYANFAMQEADVLIALGVRFDDRVTGKVDTFAPAAKAAAAEGRGGIIHFEIQPKNINKIVEGQIPVLGDVVASLGELVPQIEAVDRSAWIGRCKATKERYPFTYTPSQEGQKLKPQEVVQELDRQAEALGKEKFVISTGVGQHQMWACQYYRWTEPRSWVSSGGLGTMGFGLPSAIGAKVAAPEKYVIDIDGDASFSMTAMELATASQYDIGVKVLLFNNEFQGMVEQWQDLFYENRYSRTRMTNPDFVKLSESMGAKGLRCTKLEDLPRMMKEFLEYDGKRPIVLECLVSSEHVYPMIPAGKALHEQLLHPLLRNGSE

SEQ ID NO: 14145 - protein, 237 aa, Oryza sativa
MEMTRSLTLVPLPATLRPASAACRRRRRRRGLPFGALFSPSPPSNEMHIRALQPRQDWVGEWVRSNDTLVRGLPILGGGASLLAVLLNRAVSGIAAVADASRTWDSLTTATCCKSLVVVYGGNCVLQIGVAAGSPEDGNAVMVDAQKFMQGSLYRSAMESKKQSYLANLALYPGRTELPFLPANTQALILQPIGDKGIAVIGGDTIRGFTNLDQVLFLIYSLLTYIVPRFVLGDSHR

SEQ ID NO: 14146 - protein, 278 aa, Arabidopsis thaliana
MSMSRLGLLLFVAILLVLLQSSTCLISSPSSIINPSKVKQVSSKPRAFVYEGFLTDLECDHLISLAKENLQRSAVADNDNGESQVSDVRTSSGTFISKGKDPIVSGIEDKLSTWTFLPKENGEDLQVLRYEHGQKYDAHFDYFHDKVNIARGGHRIATVLLYLSNVTKGGETVFPDAQVCLKPKKGNALLFFNLQQDAIPDPFSLHGGCPVIEGEKWSATKWIHVDSFDKILTHDGNCTDVNESCERWAVLGECGKNPEYMVGTPEIPGNCRRSCKAC

SEQ ID NO: 14147 - protein, 105 aa, Lycopersicon esculentum
MSASGGTGDEDKKPNDQMVHINLKVKGQDGNEVFFRIKRSTQMRKLMNAYCDRQSVDMNSIAFLFDGRRLRAEQTPDELEMEEGDEIDAMLHQTGGSCCTCFSNF
